(12) United States Patent
Russ, IV et al.

(10) Patent No.: US 12,421,518 B2
(45) Date of Patent: Sep. 23, 2025

(54) METHODS AND COMPOSITIONS FOR TREATING HYPEROXALURIA

(71) Applicant: Tenza, Inc., Boston, MA (US)

(72) Inventors: Zachary Nicholas Russ, IV, San Bruno, CA (US); Weston Robert Whitaker, Daly City, CA (US); William Cain DeLoache, Alameda, CA (US); Elizabeth Joy Stanley Shepherd, Redwood City, CA (US)

(73) Assignee: Tenza, Inc., Boston, MA (US)

(*) Notice: Subject to any disclaimer, the term of this patent is extended or adjusted under 35 U.S.C. 154(b) by 1006 days.

(21) Appl. No.: 17/312,166

(22) PCT Filed: Dec. 10, 2019

(86) PCT No.: PCT/US2019/065446
§ 371 (c)(1),
(2) Date: Jun. 9, 2021

(87) PCT Pub. No.: WO2020/123483
PCT Pub. Date: Jun. 18, 2020

(65) Prior Publication Data
US 2022/0017909 A1 Jan. 20, 2022

Related U.S. Application Data

(60) Provisional application No. 62/777,322, filed on Dec. 10, 2018.

(51) Int. Cl.
*C12N 15/74* (2006.01)
*A61K 35/741* (2015.01)
*C12N 1/20* (2006.01)
*C12N 9/00* (2006.01)
*C12N 9/02* (2006.01)
*C12N 9/10* (2006.01)
*C12N 9/88* (2006.01)

(52) U.S. Cl.
CPC ............ *C12N 15/74* (2013.01); *A61K 35/741* (2013.01); *C12N 1/205* (2021.05); *C12N 9/0008* (2013.01); *C12N 9/13* (2013.01); *C12N 9/88* (2013.01); *C12N 9/93* (2013.01); *C12N 2800/204* (2013.01); *C12N 2800/22* (2013.01); *C12N 2840/105* (2013.01); *C12Y 102/01017* (2013.01); *C12Y 102/0701* (2013.01); *C12Y 208/03002* (2013.01); *C12Y 208/03016* (2013.01); *C12Y 401/01002* (2013.01); *C12Y 401/01008* (2013.01); *C12Y 602/01008* (2013.01)

(58) Field of Classification Search
None
See application file for complete search history.

(56) References Cited

U.S. PATENT DOCUMENTS

| | | |
|---|---|---|
| 6,200,562 B1 | 3/2001 | Allison et al. |
| 6,355,242 B1 | 3/2002 | Allison et al. |
| 6,699,469 B2 | 3/2004 | Allison et al. |
| 7,101,565 B2 | 9/2006 | Monte |
| 7,988,961 B2 | 8/2011 | Farrar et al. |
| 8,486,389 B2 | 7/2013 | Sidhu et al. |
| 8,759,039 B2 | 6/2014 | Hehemann et al. |
| 9,011,834 B1 | 4/2015 | McKenzie et al. |
| 9,371,510 B2 | 6/2016 | Moore |
| 9,889,164 B2 | 2/2018 | Falb et al. |
| 10,058,574 B2 | 8/2018 | Grant et al. |
| 10,125,176 B2 | 11/2018 | Lindner et al. |
| 10,149,866 B2 | 12/2018 | Sidhu et al. |
| 10,653,726 B2 | 5/2020 | Sidhu et al. |
| 10,925,953 B2 | 2/2021 | Flavell et al. |
| 2016/0158294 A1 | 6/2016 | Von Maltzahn et al. |
| 2018/0155711 A1 | 6/2018 | Anderson et al. |
| 2018/0325963 A1 | 11/2018 | Isabella et al. |
| 2019/0055529 A1 | 2/2019 | Sonnenburg et al. |
| 2019/0085035 A1 | 3/2019 | Lindner et al. |
| 2020/0085884 A1 | 3/2020 | Sonnenburg et al. |
| 2020/0129566 A1 | 4/2020 | Carbonnel |
| 2020/0206283 A1 | 7/2020 | Segal et al. |
| 2020/0268813 A1 | 8/2020 | Benoist et al. |
| 2020/0276249 A1 | 9/2020 | O'Brien et al. |
| 2020/0376046 A1 | 12/2020 | Borody |
| 2020/0390830 A1 | 12/2020 | Allen-Vercoe |
| 2021/0054356 A1 | 2/2021 | Sonnenburg et al. |
| 2021/0060091 A1 | 3/2021 | Chen et al. |

FOREIGN PATENT DOCUMENTS

| | | |
|---|---|---|
| CN | 1365284 A | 8/2002 |
| WO | 2000072855 A2 | 12/2000 |
| WO | WO-2015003001 A1 | 1/2015 |
| WO | WO-2016201174 A2 | 12/2016 |
| WO | WO-2017040719 A1 | 3/2017 |

(Continued)

OTHER PUBLICATIONS

Bowie et al. (Science, 1990, 247:1306-1310).*
Burgess et al. (J. Cell Biol. 111:2129-2138, 1990).*
Lazar et al. (Mol. Cell. Biol., 8:1247-1252, 1988).*
Abe et al. (1996) "Cloning, Sequencing, and Expression in *Escherichia coli* of OxlT, the Oxalate:Formate Exchange Protein of *Oxalobacter formigenes*," The Journal of Biological Chemistry, 271(12): 6789-6793.
International Search Report for PCT/US2019/065446, mailed Mar. 4, 2020(9 pages).
Sasikumar et al. (2014) "Recombinant *Lactobacillus plantarum* expressing and secreting heterologous oxalate decarboxylase prevents renal calcium oxalate stone deposition in experimental rats," Journal of Biomedical Science, 21(86) (13 pages).
Written Opinion for PCT/US2019/065446, mailed Mar. 4, 2020(6 pages).

(Continued)

*Primary Examiner* — Brian Gangle
(74) *Attorney, Agent, or Firm* — Mayim E. Wiens

(57) ABSTRACT

The disclosure relates generally to bacteria that have been modified to have increased oxalate degrading activity, pharmaceutical compositions including the bacteria, and methods of treating disorders associated with an elevated amount of oxalate, e.g., hyperoxaluria.

13 Claims, 17 Drawing Sheets

Specification includes a Sequence Listing.

(56) References Cited

FOREIGN PATENT DOCUMENTS

| WO | WO-2017184565 A1 | 10/2017 |
|---|---|---|
| WO | 2018112194 A1 | 6/2018 |
| WO | WO-2018122194 A1 | 7/2018 |
| WO | WO-2018195136 A1 | 10/2018 |
| WO | WO-2019195942 A1 | 10/2019 |
| WO | WO-2019203625 A1 | 10/2019 |
| WO | WO-2020041581 A1 | 2/2020 |
| WO | WO-2020055193 A1 | 3/2020 |
| WO | WO-2020198503 A1 | 10/2020 |
| WO | WO-2020215055 A1 | 10/2020 |
| WO | WO-2020215356 A1 | 10/2020 |
| WO | WO-2020227420 A1 | 11/2020 |
| WO | WO-2020252370 A1 | 12/2020 |
| WO | WO-2020264390 A2 | 12/2020 |

OTHER PUBLICATIONS

Ye et al. (2007) "Stable expression of the oxc and frc genes from *Oxalobacter formigenes* in human embryo kidney 293 cells: Implications for gene therapy of hyperoxaluria," International Journal Of Molecular Medicine, 20: 521-526.

Duong et al., "Construction of Vectors for Inducible and Constitutive Gene Expression in Lactobacillus", Microbial Biotechnology, vol. 4, No. 3, pp. 357-367, Sep. 1, 2010.

Abratt, et al., "Oxalate-Degrading Bacteria of the Human Gut as Probiotics in the Management of Kidney Stone Disease", Advances In Applied Microbiology, Academic Press, United States, vol. 72, pp. 63-87, Jan. 1, 2010.

Extended European Search Report for European Patent Application No. 19895497.6, mailed Aug. 11, 2022.

\* cited by examiner

METHODS AND COMPOSITIONS FOR TREATING HYPEROXALURIA

CROSS REFERENCE TO RELATED APPLICATIONS

This application is a § 371 National Stage of International (PCT) Patent Application Serial No. PCT/US2019/065446, filed on Dec. 10, 2019, which claims the benefit of, and priority to, U.S. Provisional Patent Application No. 62/777,322, filed on Dec. 10, 2018, the disclosures of each of which is are hereby incorporated by reference in their entirety for all purposes.

REFERENCE TO LENGTHY TABLE

The instant application contains a lengthy table section. A copy of the table has been submitted in ASCII format and is hereby incorporated by reference in its entirety. Said ASCII table, created on Jul. 16, 2025, is named "2025 Jul. 16 TNZ-011WOUS Lengthy Table" and is 731,816 bytes in size.

BACKGROUND

Oxalic acid, the smallest dicarboxylic acid, frequently appears in nature both as a useful secondary metabolite and also a byproduct of catabolic processes. Plants produce and accumulate large quantities of oxalate as a way to poison herbivores and prevent predation. Several metabolic processes also generate oxalate inside the bodies of mammals Toxic oxalate must be disposed of, and in mammals this is done by transport of oxalate into the urine and feces. However, if too much oxalate is disposed of into the urine, hyperoxaluria can occur.

Hyperoxaluria is the condition of excreting excess oxalate in the urine. Elevated urinary oxalate has been linked to recurrent calcium oxalate kidney stones, kidney damage, and eventually end-stage renal disease. Hyperoxaluria is categorized into four classes by the major source of the excess oxalate: primary, enteric, dietary, and idiopathic hyperoxaluria. Primary hyperoxaluria concerns hyperoxaluria where the causes are genetic; its three forms, I, II, and III, are caused by mutations in the human genes AGXT, GRHPR, and HOGA1, respectively. Mutations in any of these genes result in increased levels of oxalate generated by endogenous processes in the liver. The forms of hyperoxaluria where a genetic cause cannot be established—enteric, dietary, and idiopathic hyperoxaluria—are termed secondary hyperoxaluria. While some baseline level of absorption of oxalate from the diet is normal, in patients with enteric hyperoxaluria the permeability of the intestine to oxalate has been increased, causing greater absorption of oxalate from the diet. This can be caused by disrupted gut physiology from conditions including inflammatory bowel disease and gastric bypass. Dietary hyperoxaluria stems from an overconsumption of oxalate or oxalate precursors in the diet. Finally, for patients with idiopathic hyperoxaluria an acute cause of their hyperoxaluria has not been identified.

Few treatments for hyperoxaluria exist. For primary hyperoxaluria patients with a mutation in AXGT, pyridoxine can be prescribed to salvage some activity of the mutated enzyme. Alternatively, primary hyperoxaluria patients can receive a liver transplant to replace missing liver enzymes. For the remainder of hyperoxaluria patients, a high-calcium, low-oxalate diet is the primary intervention, along with other treatments aimed at correcting complications—kidney stones and renal failure. However, oxalate is difficult to avoid even with careful dieting, and instructing patients to avoid oxalate is most often insufficient. With such limited treatments available to mitigate hyperoxaluria, patients need a powerful, stable treatment to remove oxalate from their bodies.

Accordingly, there is an ongoing need for new and effective therapies for treating and managing diseases or disorders associated with an elevated amount of oxalate such as hyperoxaluria.

BRIEF SUMMARY

The disclosure relates generally to a bacterium that has been modified to have increased oxalate degrading activity. Disclosed bacteria are useful for treating disorders associated with an elevated amount of oxalate in a subject, e.g., hyperoxaluria.

For example, in one aspect, provided herein is a commensal bacterium that has been modified to have increased oxalate degrading activity relative to a similar or otherwise identical bacterium that has not been modified. In certain embodiments, a similar or otherwise identical bacterium that has not been modified has no detectable oxalate degrading activity and/or has no genes known to be involved, e.g., directly involved, in oxalate catabolism. In certain embodiments, no naturally occurring member of the same genus as the bacterium has detectable oxalate degrading activity.

In certain embodiments, a contemplated bacterium is of a genus selected from the group consisting of *Bacteroides*, *Alistipes*, *Faecalibacterium*, *Parabacteroides*, *Prevotella*, *Roseburia*, *Ruminococcus*, *Clostridium*, *Oscillibacter*, *Gemmiger*, *Barnesiella*, *Dialister*, *Parasutterella*, *Phascolarctobacterium*, *Propionibacterium*, *Sutterella*, *Blautia*, *Paraprevotella*, *Coprococcus*, *Odoribacter*, *Spiroplasma*, *Anaerostipes*, and *Akkermansia*. For example, a contemplated bacterium may be of the *Bacteroides* genus, i.e., may be a *Bacteroides* species bacterium.

In certain embodiments, a contemplated bacterium comprises one or more transgenes encoding a protein, or a functional fragment or variant thereof, selected from the group consisting of: an oxalate:formate antiporter (OxlT); an oxalate decarboxylase (OXDC)—EC 4.1.1.2; an oxalate oxidase (OXO)—EC 1.2.3.4; an oxalate oxidoreductase (OOR)—EC 1.2.7.10; an oxalate-CoA ligase/Oxalyl-CoA synthetase (OXS)—EC 6.2.1.8; a formyl-CoA:oxalate CoA-transferase (FCOCT)—EC 2.8.3.16; an acetyl-CoA:oxalate CoA-transferase (ACOCT)—EC 2.8.3.19; a succinyl-CoA: oxalate CoA-transferase (SCOCT)—EC 2.8.3.2; an oxalyl-CoA decarboxylase (OXC)—EC 4.1.1.8; an oxalyl-CoA reductase/glyoxylate:NADP+oxidoreductase (OXR)—EC 1.2.1.17; and a combination of any of the foregoing proteins. It is contemplated that the one or more transgenes may, e.g., be on a plasmid, bacterial artificial chromosome, or be genomically integrated. When a bacterium comprises one or more transgenes encoding multiple proteins, it is contemplated that the open reading frames encoding two or more of the proteins may, e.g., be present in a single operon.

In certain embodiments, a contemplated bacterium comprises one or more transgenes encoding an OxlT or a functional fragment or variant thereof, an OXS or a functional fragment or variant thereof, and an OXC or a functional fragment or variant thereof. In certain embodiments, a bacterium further comprises one or more transgenes encoding a FCOCT or a functional fragment or variant thereof and/or an ACOCT or a functional fragment or variant thereof.

In certain embodiments, a contemplated bacterium comprises one or more transgenes encoding an OxIT or a functional fragment or variant thereof, an OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof. In certain embodiments, a contemplated bacterium comprises one or more transgenes encoding an OxIT or a functional fragment or variant thereof, a first OXS or a functional fragment or variant thereof, a second OXS or a functional fragment or variant thereof, an OXC or a functional fragment or variant thereof, a FCOCT or a functional fragment or variant thereof, and/or an ACOCT or a functional fragment or variant thereof. In certain embodiments, a contemplated bacterium comprises one or more transgenes encoding an OxIT or a functional fragment or variant thereof, a first OXS or a functional fragment or variant thereof, a second OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof.

In certain embodiments, a contemplated bacterium comprises one or more transgenes encoding an *O. formigenes* OxIT; a *S. cerevisiae* or an *A. thaliana* OXS; a *S. cerevisiae* or an *O. formigenes* OXC; an *E. coli* FCOCT; and/or an *E. coli* ACOCT. For example, it is contemplated that a bacterium may comprise: (i) one or more transgenes encoding a *S. cerevisiae* OXS, a *S. cerevisiae* OXC, and an *O. formigenes* OxIT; (ii) one or more transgenes encoding an *E. coli* FCOCT, an *O. formigenes* OXC, a *S. cerevisiae* OXS, and an *O. formigenes* OxIT; (iii) one or more transgenes encoding an *E. coli* FCOCT, an *O. formigenes* OXC, a *S. cerevisiae* OXS, a *S. cerevisiae* OXC, an *E. coli* ACOCT, and an *O. formigenes* OxIT; (iv) or one or more transgenes encoding an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT; (v) one or more transgenes encoding an *E. coli* FCOCT, an *O. formigenes* OXC, an *O. formigenes* OxIT, an *E. coli* ACOCT, and a *S. cerevisiae* OXS; (vi) one or more transgenes encoding an *O. formigenes* OxIT, an *E. coli* FCOCT, a *S. cerevisiae* OXC, an *E. coli* ACOCT, a *S. cerevisiae* OXS, and an *A. thaliana* OXS; or (vii) one or more transgenes encoding an *O. formigenes* OxIT, an *E. coli* FCOCT, a *S. cerevisiae* OXC, an *E. coli* ACOCT, and a *S. cerevisiae* OXS.

In certain embodiments, a contemplated bacterium comprises one or more nucleic acids comprising a nucleotide sequence having at least 80% identity to any one of SEQ ID NOs: 1-31, or comprising the nucleotide sequence of any one of SEQ ID NOs: 1-31.

For example, a contemplated bacterium may comprise: (i) one or more nucleic acids comprising a nucleotide sequence having at least 80% identity to SEQ ID NO: 16, a nucleotide sequence having at least 80% identity to SEQ ID NO: 26 or SEQ ID NO: 163, and a nucleotide sequence having at least 80% identity to SEQ ID NO: 21; (ii) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, and a nucleotide sequence having at least 80% identity to SEQ ID NO: 21; (iii) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, a nucleotide sequence having at least 80% identity to SEQ ID NO: 26 or SEQ ID NO: 163, a nucleotide sequence having at least 80% identity to SEQ ID NO: 2, and a nucleotide sequence having at least 80% identity to SEQ ID NO: 21; (iv) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, a nucleotide sequence having at least 80% identity to SEQ ID NO: 26 or SEQ ID NO: 163, a nucleotide sequence having at least 80% identity to SEQ ID NO: 14, a nucleotide sequence having at least 80% identity to SEQ ID NO: 2, and a nucleotide sequence having at least 80% identity to SEQ ID NO: 21; (v) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 21, a nucleotide sequence having at least 80% identity to SEQ ID NO: 2, and a nucleotide sequence having at least 80% identity to SEQ ID NO: 16; (vi) one or more nucleic acids comprising a nucleotide sequence having at least 80% identity to SEQ ID NO: 21, a nucleotide sequence having at least 80% identity to SEQ ID NO: 7, a nucleotide sequence having at least 80% identity to SEQ ID NO: 26 or SEQ ID NO: 163, a nucleotide sequence having at least 80% identity to SEQ ID NO: 2, a nucleotide sequence having at least 80% identity to SEQ ID NO: 16, and a nucleotide sequence having at least 80% identity to SEQ ID NO: 14; or (vii) one or more nucleic acids comprising a nucleotide sequence having at least 80% identity to SEQ ID NO: 21, a nucleotide sequence having at least 80% identity to SEQ ID NO: 7, a nucleotide sequence having at least 80% identity to SEQ ID NO: 26 or SEQ ID NO: 163, a nucleotide sequence having at least 80% identity to SEQ ID NO: 2, and a nucleotide sequence having at least 80% identity to SEQ ID NO: 16.

For example, a contemplated bacterium may comprise: (i) one or more nucleic acids comprising the nucleotide sequences of SEQ ID NO: 16, SEQ ID NO: 26 or SEQ ID NO: 163, and SEQ ID NO: 21; (ii) one or more nucleic acids comprising the nucleotide sequences of SEQ ID NO: 7, SEQ ID NO: 25, SEQ ID NO: 16, and SEQ ID NO: 21; (iii) one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 2, and SEQ ID NO: 21; (iv) one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 14, SEQ ID NO: 2, and SEQ ID NO: 21; (v) one or more nucleic acids comprising the nucleotide sequences of SEQ ID NO: 7, SEQ ID NO: 25, SEQ ID NO: 21, SEQ ID NO: 2, and SEQ ID NO: 16; (vi) one or more nucleic acids comprising the nucleotide sequences of SEQ ID NO: 21, SEQ ID NO: 7, SEQ ID NO: 26 or SEQ ID NO: 163, SEQ ID NO: 2, SEQ ID NO: 16, and SEQ ID NO: 14; or (vii) one or more nucleic acids comprising the nucleotide sequences of SEQ ID NO: 21, SEQ ID NO: 7, SEQ ID NO: 26 or SEQ ID NO: 163, SEQ ID NO: 2, and SEQ ID NO: 16.

In certain embodiments, a transgene or nucleic acid is operably linked to a ribosome binding site (RBS). Exemplary RBSs include those comprising the nucleotide sequence of any one of SEQ ID NOs: 164-230. For example, a contemplated bacterium may comprise: (i) a transgene encoding an *O. formigenes* OxIT operably linked to an RBS comprising the nucleotide sequence of any one of SEQ ID NOs: 212-219; (ii) a transgene encoding a *S. cerevisiae* OXS operably linked to an RBS comprising the nucleotide sequence of any one of SEQ ID NOs: 172-179; (iii) a transgene encoding an *A. thaliana* OXS operably linked to an RBS comprising the nucleotide sequence of any one of SEQ ID NOs: 164-171; (iv) a transgene encoding a *S. cerevisiae* OXC operably linked to an RBS comprising the nucleotide sequence of any one of SEQ ID NOs: 188-195 or 220-230; (v) a transgene encoding an *O. formigenes* OXC operably linked to an RBS comprising the nucleotide sequence of any one of ID NOs: 180-187; (vi) a transgene encoding an *E. coli* FCOCT operably linked to an RBS comprising the nucleotide sequence of any one of SEQ ID NOs: 204-211; and/or (vii) transgene encoding an *E. coli* ACOCT operably linked to an RBS comprising the nucleotide sequence of any one of SEQ ID NOs: 196-203.

In certain embodiments, a contemplated bacterium comprises one or more nucleic acids comprising a nucleotide sequence having at least 80% identity to any one of SEQ ID NOs: 96-162, or comprising the nucleotide sequence of any one of SEQ ID NOs: 96-162.

For example, a contemplated bacterium may comprise: (i) one or more nucleic acids comprising a nucleotide sequence having at least 80% identity to SEQ ID NO: 137, a nucleotide sequence having at least 80% identity to SEQ ID NO: 113, a nucleotide sequence having at least 80% identity to SEQ ID NO: 145, a nucleotide sequence having at least 80% identity to SEQ ID NO: 128, and a nucleotide sequence having at least 80% identity to SEQ ID NO: 104; (ii) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 148, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (iii) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 144, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (iv) one or more nucleic acids comprising a nucleotide sequence having at least 80% identity to SEQ ID NO: 147, a nucleotide sequence having at least 80% identity to SEQ ID NO: 104, a nucleotide sequence having at least 80% identity to SEQ ID NO: 153, a nucleotide sequence having at least 80% identity to SEQ ID NO: 97, a nucleotide sequence having at least 80% identity to SEQ ID NO: 131, a nucleotide sequence having at least 80% identity to SEQ ID NO: 136, and a nucleotide sequence having at least 80% identity to SEQ ID NO: 113; (v) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, a nucleotide sequence having at least 80% identity to SEQ ID NO: 113, and a nucleotide sequence having at least 80% identity to SEQ ID NO: 96; (vi) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, and a nucleotide sequence having at least 80% identity to SEQ ID NO: 96; (vii) one or more nucleic acids comprising a nucleotide sequence having at least 80% identity to SEQ ID NO: 139, a nucleotide sequence having at least 80% identity to SEQ ID NO: 129, a nucleotide sequence having at least 80% identity to SEQ ID NO: 155, a nucleotide sequence having at least 80% identity to SEQ ID NO: 112, a nucleotide sequence having at least 80% identity to SEQ ID NO: 99, a nucleotide sequence having at least 80% identity to SEQ ID NO: 106, and a nucleotide sequence having at least 80% identity to SEQ ID NO: 145; (viii) one or more nucleic acids comprising a nucleotide sequence having at least 80% identity to SEQ ID NO: 139, a nucleotide sequence having at least 80% identity to SEQ ID NO: 154, a nucleotide sequence having at least 80% identity to SEQ ID NO: 131, a nucleotide sequence having at least 80% identity to SEQ ID NO: 98, a nucleotide sequence having at least 80% identity to SEQ ID NO: 115, a nucleotide sequence having at least 80% identity to SEQ ID NO: 106, and a nucleotide sequence having at least 80% identity to SEQ ID NO: 149; (ix) one or more nucleic acids comprising a nucleotide sequence having at least 80% identity to SEQ ID NO: 137, a nucleotide sequence having at least 80% identity to SEQ ID NO: 113, a nucleotide sequence having at least 80% identity to SEQ ID NO: 148, a nucleotide sequence having at least 80% identity to SEQ ID NO: 129, and a nucleotide sequence having at least 80% identity to SEQ ID NO: 105; (x) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, and a nucleotide sequence having at least 80% identity to SEQ ID NO: 105; (xi) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 144, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (xii) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, a nucleotide sequence having at least 80% identity to SEQ ID NO: 113, and a nucleotide sequence having at least 80% identity to SEQ ID NO: 96; (xiii) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, and a nucleotide sequence having at least 80% identity to SEQ ID NO: 96; or (xiv) one or more nucleic acids comprising a nucleotide sequence having at least 80% identity to SEQ ID NO: 139, a nucleotide sequence having at least 80% identity to SEQ ID NO: 129, a nucleotide sequence having at least 80% identity to SEQ ID NO: 155, a nucleotide sequence having at least 80% identity to SEQ ID NO: 112, a nucleotide sequence having at least 80% identity to SEQ ID NO: 99, a nucleotide sequence having at least 80% identity to SEQ ID NO: 106, and a nucleotide sequence having at least 80% identity to SEQ ID NO: 145.

For example, a contemplated bacterium may comprise: (i) one or more nucleic acids comprising the nucleotide sequences of SEQ ID NO: 137, SEQ ID NO: 113, SEQ ID NO: 145, SEQ ID NO: 128, and SEQ ID NO: 104; (ii) one or more nucleic acids comprising the nucleotide sequences of SEQ ID NO: 155, SEQ ID NO: 137, SEQ ID NO: 128, SEQ ID NO: 148, SEQ ID NO: 115, SEQ ID NO: 98, and SEQ ID NO: 105; (iii) one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105; (iv) one or more nucleic acids comprising the nucleotide sequences of SEQ ID NO: 147, SEQ ID NO: 104, SEQ ID NO: 153, SEQ ID NO: 97, SEQ ID NO: 131, SEQ ID NO: 136, and SEQ ID NO: 113; (v) one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96; (vi) one or more nucleic acids comprising the nucleotide sequences of SEQ ID NO: 145, SEQ ID NO: 137, SEQ ID NO: 153, SEQ ID NO: 129, SEQ ID NO: 105, and SEQ ID NO: 96; (vii) one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145; (viii) one or more nucleic acids comprising the nucleotide sequences of SEQ ID NO: 139, SEQ ID NO: 154, SEQ ID NO: 131, SEQ ID NO: 98, SEQ ID NO: 115, SEQ ID NO: 106, and SEQ ID NO: 149; (ix) one or more nucleic acids comprising the nucleotide sequences of SEQ ID NO: 137, SEQ ID NO: 113, SEQ ID NO: 148, SEQ ID NO: 129, and SEQ ID NO: 105; (x) one or more nucleic acids comprising the nucleotide sequences of SEQ ID NO: 145, SEQ ID NO: 137, SEQ ID NO: 153, SEQ ID NO: 129, and SEQ ID NO: 105; (xi) one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105; (xii) one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96; (xiii) one or more nucleic acids comprising the nucleotide sequences of SEQ ID NO: 145, SEQ ID NO: 137, SEQ ID NO: 153, SEQ ID NO: 129, SEQ ID NO: 105, and SEQ ID NO: 96; or (xiv) one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145.

In certain embodiments, a contemplated bacterium comprises one or more nucleic acids comprising a nucleotide sequence having at least 80% identity to any one of SEQ ID NOs: 82-95, or comprising the nucleotide sequence of any one of SEQ ID NOs: 82-95.

In certain embodiments, a transgene or nucleic acid is operably linked to at least one constitutive promoter, e.g., a phage-derived promoter. Exemplary promoters include those comprising the consensus sequence GTTAA(n)$_{4-7}$GT-TAA(n)$_{34-38}$TA(n)$_2$TTTG (SEQ ID: 70), or comprising SEQ ID NO: 68, SEQ ID NO: 69, or SEQ ID NO: 71.

In certain embodiments, a contemplated bacterium has been modified to colonize the human gut with increased abundance, stability, predictability or ease of initial colonization relative to a similar or otherwise identical bacterium that has not been modified. For example, a contemplated bacterium may be modified to increase its ability to utilize a privileged nutrient as carbon source. For example, a contemplated bacterium may comprise one or more transgenes that increase its ability to utilize a privileged nutrient as carbon source. Exemplary privileged nutrients include, e.g., a marine polysaccharide, e.g., a porphyran. A disclosed bacterium may, e.g., upon administration to a human subject, result in an abundance greater than $10^{12}$, $10^{11}$, $10^{10}$, $10^9$, $10^8$, or $10^7$ cfu per gram of fecal content.

In another aspect, provided herein is a pharmaceutical composition comprising a disclosed bacterium and a pharmaceutically acceptable excipient. In certain embodiments, a contemplated pharmaceutical composition is formulated as a capsule or tablet, e.g., an enteric coated capsule. In certain embodiments, a contemplated pharmaceutical composition further comprises a privileged nutrient, e.g., a marine polysaccharide, e.g., a porphyran.

In another aspect, provided herein is a method of reducing oxalate in a subject in need thereof. A contemplated method comprises administering to the subject an effective amount of a disclosed bacterium or pharmaceutical composition. In certain embodiments, a subject has a disorder associated with an elevated amount of oxalate, e.g., hyperoxaluria. In another aspect, provided herein is a method of treating a disorder associated with an elevated amount of oxalate in a subject, e.g., hyperoxaluria. A contemplated method comprises administering to the subject an effective amount of a disclosed bacterium or pharmaceutical composition.

Contemplated methods may comprise administration of a disclosed bacterium or pharmaceutical composition to a subject every 12 hours, 24 hours, day, 2 days, 3 days, 4 days, 5 days, 6 days, 7 days, week, 2 weeks, 3 weeks, 4 weeks, month, 2 months, 3 months, 4 months, 5 months, or 6 months. In certain embodiments, the time between consecutive administrations of a disclosed bacterium or pharmaceutical composition to a subject is greater than 48 hours.

Contemplated methods may further comprise administrating a privileged nutrient to the subject, e.g., a marine polysaccharide, e.g., a porphyran. For example, a disclosed privileged nutrient may be administered to the subject prior to, at the same time as, or after a disclosed bacterium.

In another aspect, the invention provides an expression vector encoding a protein, or a functional fragment or variant thereof, selected from the group consisting of: an oxalate:formate antiporter (OxlT); an oxalate decarboxylase (OXDC)—EC 4.1.1.2; an oxalate oxidase (OXO)—EC 1.2.3.4; an oxalate oxidoreductase (OOR)—EC 1.2.7.10; an oxalate-CoA ligase/Oxalyl-CoA synthetase (OXS)—EC 6.2.1.8; a formyl-CoA:oxalate CoA-transferase (FCOCT)—EC 2.8.3.16; an acetyl-CoA:oxalate CoA-transferase (ACOCT)—EC 2.8.3.19; a succinyl-CoA:oxalate CoA-transferase (SCOCT)—EC 2.8.3.2; an oxalyl-CoA decarboxylase (OXC)—EC 4.1.1.8; an oxalyl-CoA reductase/glyoxylate:NADP+oxidoreductase (OXR)—EC 1.2.1.17; and a combination of any of the foregoing proteins. Exemplary expression vectors include, e.g., a plasmid, and a bacterial artificial chromosome. When an expression vector comprises one or more transgenes encoding multiple proteins, it is contemplated that the open reading frames encoding two or more of the proteins may, e.g., be present in a single operon.

In certain embodiments, a contemplated expression vector comprises one or more transgenes encoding an OxIT or a functional fragment or variant thereof, an OXS or a functional fragment or variant thereof, and an OXC or a functional fragment or variant thereof. In certain embodiments, an expression vector further comprises one or more transgenes encoding a FCOCT or a functional fragment or variant thereof and/or an ACOCT or a functional fragment or variant thereof.

In certain embodiments, a contemplated expression vector comprises one or more transgenes encoding an OxIT or a functional fragment or variant thereof, an OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof. In certain embodiments, a contemplated expression vector comprises one or more transgenes encoding an OxIT or a functional fragment or variant thereof, a first OXS or a functional fragment or variant thereof, a second OXS or a functional fragment or variant thereof, an OXC or a functional fragment or variant thereof, a FCOCT or a functional fragment or variant thereof, and/or an ACOCT or a functional fragment or variant thereof. In certain embodiments, a contemplated expression vector comprises one or more transgenes encoding an OxIT or a functional fragment or variant thereof, a first OXS or a functional fragment or variant thereof, a second OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof.

In certain embodiments, a contemplated expression vector comprises one or more transgenes encoding an *O. formigenes* OxIT; a *S. cerevisiae* or an *A. thaliana* OXS; a *S. cerevisiae* or an *O. formigenes* OXC; an *E. coli* FCOCT; and/or an *E. coli* ACOCT. For example, it is contemplated that an expression vector may comprise: (i) one or more transgenes encoding a *S. cerevisiae* OXS, a *S. cerevisiae* OXC, and an *O. formigenes* OxIT; (ii) one or more transgenes encoding an *E. coli* FCOCT, an *O. formigenes* OXC, a *S. cerevisiae* OXS, and an *O. formigenes* OxIT; (iii) one or more transgenes encoding an *E. coli* FCOCT, an *O. formigenes* OXC, a *S. cerevisiae* OXS, a *S. cerevisiae* OXC, an *E. coli* ACOCT, and an *O. formigenes* OxIT; (iv) or one or more transgenes encoding an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT; (v) one or more transgenes encoding an *E. coli* FCOCT, an *O. formigenes* OXC, an *O. formigenes* OxIT, an *E. coli* ACOCT, and a *S. cerevisiae* OXS; (vi) one or more transgenes encoding an *O. formigenes* OxIT, an *E. coli* FCOCT, a *S. cerevisiae* OXC, an *E. coli* ACOCT, a *S. cerevisiae* OXS, and an *A. thaliana* OXS; or (vii) one or more transgenes encoding an *O. formigenes* OxIT, an *E. coli* FCOCT, a *S. cerevisiae* OXC, an *E. coli* ACOCT, and a *S. cerevisiae* OXS.

In certain embodiments, a contemplated expression vector comprises one or more nucleic acids comprising a nucleotide sequence having at least 80% identity to any one of SEQ ID NOs: 1-31, or comprising the nucleotide sequence of any one of SEQ ID NOs: 1-31.

For example, a contemplated expression vector may comprise: (i) one or more nucleic acids comprising a nucleotide sequence having at least 80% identity to SEQ ID NO: 16, a nucleotide sequence having at least 80% identity to SEQ ID NO: 26 or SEQ ID NO: 163, and a nucleotide sequence having at least 80% identity to SEQ ID NO: 21; (ii) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, and a nucleotide sequence having at least 80% identity to SEQ ID NO: 21; (iii) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, a nucleotide sequence having at least 80% identity to SEQ ID NO: 26 or SEQ ID NO: 163, a nucleotide sequence having at least 80% identity to SEQ ID NO: 2, and a nucleotide sequence having at least 80% identity to SEQ ID NO: 21; (iv) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 16, a nucleotide sequence having at least 80% identity to SEQ ID NO: 26 or SEQ ID NO: 163, a nucleotide sequence having at least 80% identity to SEQ ID NO: 14, a nucleotide sequence having at least 80% identity to SEQ ID NO: 2, and a nucleotide sequence having at least 80% identity to SEQ ID NO: 21; (v) one or more nucleic acids comprising a nucleotide sequence having at least 80% identity to SEQ ID NO: 7, a nucleotide sequence having at least 80% identity to SEQ ID NO: 25, a nucleotide sequence having at least 80% identity to SEQ ID NO: 21, a nucleotide sequence having at least 80% identity to SEQ ID NO: 2, and a nucleotide sequence having at least 80% identity to SEQ ID NO: 16; (vi) one or more nucleic acids comprising a nucleotide sequence having at least 80% identity to SEQ ID NO: 21, a nucleotide sequence having at least 80% identity to SEQ ID NO: 7, a nucleotide sequence having at least 80% identity to SEQ ID NO: 26 or SEQ ID NO: 163, a nucleotide sequence having at least 80% identity to SEQ ID NO: 2, a nucleotide sequence having at least 80% identity to SEQ ID NO: 16, and a nucleotide sequence having at least 80% identity to SEQ ID NO: 14; or (vii) one or more nucleic acids comprising a nucleotide sequence having at least 80% identity to SEQ ID NO: 21, a nucleotide sequence having at least 80% identity to SEQ ID NO: 7, a nucleotide sequence having at least 80% identity to SEQ ID NO: 26 or SEQ ID NO: 163, a nucleotide sequence having at least 80% identity to SEQ ID NO: 2, and a nucleotide sequence having at least 80% identity to SEQ ID NO: 16.

For example, a contemplated expression vector may comprise: (i) one or more nucleic acids comprising the nucleotide sequences of SEQ ID NO: 16, SEQ ID NO: 26 or SEQ ID NO: 163, and SEQ ID NO: 21; (ii) one or more nucleic acids comprising the nucleotide sequences of SEQ ID NO: 7, SEQ ID NO: 25, SEQ ID NO: 16, and SEQ ID NO: 21; (iii) one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 2, and SEQ ID NO: 21; (iv) one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 14, SEQ ID NO: 2, and SEQ ID NO: 21; (v) one or more nucleic acids comprising the nucleotide sequences of SEQ ID NO: 7, SEQ ID NO: 25, SEQ ID NO: 21, SEQ ID NO: 2, and SEQ ID NO: 16; (vi) one or more nucleic acids comprising the nucleotide sequences of SEQ ID NO: 21, SEQ ID NO: 7, SEQ ID NO: 26 or SEQ ID NO: 163, SEQ ID NO: 2, SEQ ID NO: 16, and SEQ ID NO: 14; or (vii) one or more nucleic acids comprising the nucleotide sequences of SEQ ID NO: 21, SEQ ID NO: 7, SEQ ID NO: 26 or SEQ ID NO: 163, SEQ ID NO: 2, and SEQ ID NO: 16.

In certain embodiments, a transgene or nucleic acid is operably linked to a ribosome binding site (RBS). Exemplary RBSs include those comprising the nucleotide sequence of any one of SEQ ID NOs: 164-230. For example, a contemplated expression vector may comprise: (i) a transgene encoding an *O. formigenes* OxlT operably linked to an RBS comprising the nucleotide sequence of any one of SEQ ID NOs: 212-219; (ii) a transgene encoding a *S. cerevisiae* OXS operably linked to an RBS comprising the nucleotide sequence of any one of SEQ ID NOs: 172-179; (iii) a transgene encoding an *A. thaliana* OXS operably linked to an RBS comprising the nucleotide sequence of any one of SEQ ID NOs: 164-171; (iv) a transgene encoding a *S. cerevisiae* OXC operably linked to an RBS comprising the nucleotide sequence of any one of SEQ ID NOs: 188-195 or 220-230; (v) a transgene encoding an *O. formigenes* OXC operably linked to an RBS comprising the nucleotide sequence of any one of SEQ ID NOs: 180-187; (vi) a transgene encoding an *E. coli* FCOCT operably linked to an RBS comprising the nucleotide sequence of any one of SEQ ID NOs: 204-211; and/or (vii) transgene encoding an *E. coli* ACOCT operably linked to an RBS comprising the nucleotide sequence of any one of SEQ ID NOs: 196-203.

In certain embodiments, a contemplated expression vector comprises one or more nucleic acids comprising a nucleotide sequence having at least 80% identity to any one of SEQ ID NOs: 96-162, or comprising the nucleotide sequence of any one of SEQ ID NOs: 96-162.

For example, a contemplated expression vector may comprise: (i) one or more nucleic acids comprising a nucleotide sequence having at least 80% identity to SEQ ID NO: 137, a nucleotide sequence having at least 80% identity to SEQ ID NO: 113, a nucleotide sequence having at least 80% identity to SEQ ID NO: 145, a nucleotide sequence having at least 80% identity to SEQ ID NO: 128, and a nucleotide sequence having at least 80% identity to SEQ ID NO: 104; (ii) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 148, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (iii) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 144, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (iv) one or more nucleic acids comprising a nucleotide sequence having at least 80% identity to SEQ ID NO: 147, a nucleotide sequence having at least 80% identity to SEQ ID NO: 104, a nucleotide sequence having at least 80% identity to SEQ ID NO: 153, a nucleotide sequence having at least 80% identity to SEQ ID NO: 97, a nucleotide sequence having at least 80% identity to SEQ ID NO: 131, a nucleotide sequence having at least 80% identity to SEQ ID NO: 136, and a nucleotide sequence having at least 80% identity to SEQ ID NO: 113; (v) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, a nucleotide sequence having at least 80% identity to SEQ ID NO: 113, and a nucleotide sequence having at least 80% identity to SEQ ID NO: 96; (vi) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, and a nucleotide sequence having at least 80% identity to SEQ ID NO: 96; (vii) one or more nucleic acids comprising a nucleotide sequence having at least 80% identity to SEQ ID NO: 139, a nucleotide sequence having at least 80% identity to SEQ ID NO: 129, a nucleotide sequence having at least 80% identity to SEQ ID NO: 155, a nucleotide sequence having at least 80% identity to SEQ ID NO: 112, a nucleotide sequence having at least 80% identity to SEQ ID NO: 99, a nucleotide sequence having at least 80% identity to SEQ ID NO: 106, and a nucleotide sequence having at least 80% identity to SEQ ID NO: 145; (viii) one or more nucleic acids comprising a nucleotide sequence having at least 80% identity to SEQ ID NO: 139, a nucleotide sequence having at least 80% identity to SEQ ID NO: 154, a nucleotide sequence having at least 80% identity to SEQ ID NO: 131, a nucleotide sequence having at least 80% identity to SEQ ID NO: 98, a nucleotide sequence having at least 80% identity to SEQ ID NO: 115, a nucleotide sequence having at least 80% identity to SEQ ID NO: 106, and a nucleotide sequence having at least 80% identity to SEQ ID NO: 149; (ix) one or more nucleic acids comprising a nucleotide sequence having at least 80% identity to SEQ ID NO: 137, a nucleotide sequence having at least 80% identity to SEQ ID NO: 113, a nucleotide sequence having at least 80% identity to SEQ ID NO: 148, a nucleotide sequence having at least 80% identity to SEQ ID NO: 129, and a nucleotide sequence having at least 80% identity to SEQ ID NO: 105; (x) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, and a nucleotide sequence having at least 80% identity to SEQ ID NO: 105; (xi) one or more nucleic acids comprising a nucleotide sequence having at least 80% identity to SEQ ID NO: 155, a nucleotide sequence having at least 80% identity to SEQ ID NO: 137, a nucleotide sequence having at least 80% identity to SEQ ID NO: 128, a nucleotide sequence having at least 80% identity to SEQ ID NO: 144, a nucleotide sequence having at least 80% identity to SEQ ID NO: 115, a nucleotide sequence having at least 80% identity to SEQ ID NO: 98, and a nucleotide sequence having at least 80% identity to SEQ ID NO: 105; (xii) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, a nucleotide sequence having at least 80% identity to SEQ ID NO: 113, and a nucleotide sequence having at least 80% identity to SEQ ID NO: 96; (xiii) one or more nucleic acids comprising a nucleotide sequence having at least 80% identity to SEQ ID NO: 145, a nucleotide sequence having at least 80% identity to SEQ ID NO: 137, a nucleotide sequence having at least 80% identity to SEQ ID NO: 153, a nucleotide sequence having at least 80% identity to SEQ ID NO: 129, a nucleotide sequence having at least 80% identity to SEQ ID NO: 105, and a nucleotide sequence having at least 80% identity to SEQ ID NO: 96; or (xiv) one or more nucleic acids comprising a nucleotide sequence having at least 80% identity to SEQ ID NO: 139, a nucleotide sequence having at least 80% identity to SEQ ID NO: 129, a nucleotide sequence having at least 80% identity to SEQ ID NO: 155, a nucleotide sequence having at least 80% identity to SEQ ID NO: 112, a nucleotide sequence having at least 80% identity to SEQ ID NO: 99, a nucleotide sequence having at least 80% identity to SEQ ID NO: 106, and a nucleotide sequence having at least 80% identity to SEQ ID NO: 145.

For example, a contemplated expression vector may comprise: (i) one or more nucleic acids comprising the nucleotide sequences of SEQ ID NO: 137, SEQ ID NO: 113, SEQ ID NO: 145, SEQ ID NO: 128, and SEQ ID NO: 104; (ii) one or more nucleic acids comprising the nucleotide sequences of SEQ ID NO: 155, SEQ ID NO: 137, SEQ ID NO: 128, SEQ ID NO: 148, SEQ ID NO: 115, SEQ ID NO: 98, and SEQ ID NO: 105; (iii) one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105; (iv) one or more nucleic acids comprising the nucleotide sequences of SEQ ID NO: 147, SEQ ID NO: 104, SEQ ID NO: 153, SEQ ID NO: 97, SEQ ID NO: 131, SEQ ID NO: 136, and SEQ ID NO: 113; (v) one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96; (vi) one or more nucleic acids comprising the nucleotide sequences of SEQ ID NO: 145, SEQ ID NO: 137, SEQ ID NO: 153, SEQ ID NO: 129, SEQ ID NO: 105, and SEQ ID NO: 96; (vii) one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145; (viii) one or more nucleic acids comprising the nucleotide sequences of SEQ ID NO: 139, SEQ ID NO: 154, SEQ ID NO: 131, SEQ ID NO: 98, SEQ ID NO: 115, SEQ ID NO: 106, and SEQ ID NO: 149; (ix) one or more nucleic acids comprising the nucleotide sequences of SEQ ID NO: 137, SEQ ID NO: 113, SEQ ID NO: 148, SEQ ID NO: 129, and SEQ ID NO: 105; (x) one or more nucleic acids comprising the nucleotide sequences of SEQ ID NO: 145, SEQ ID NO: 137, SEQ ID NO: 153, SEQ ID NO: 129, and SEQ ID NO: 105; (xi) one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105; (xii) one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96; (xiii) one or more nucleic acids comprising the nucleotide sequences of SEQ ID NO: 145, SEQ ID NO: 137, SEQ ID NO: 153, SEQ ID NO: 129, SEQ ID NO: 105, and SEQ ID NO: 96; or (xiv) one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145.

In certain embodiments, a contemplated expression vector comprises one or more nucleic acids comprising a nucleotide sequence having at least 80% identity to any one of SEQ ID NOs: 82-95, or comprising the nucleotide sequence of any one of SEQ ID NOs: 82-95.

In certain embodiments, a transgene or nucleic acid is operably linked to at least one constitutive promoter, e.g., a phage-derived promoter. Exemplary promoters include those comprising the consensus sequence GTTAA(n)$_{4-7}$GTTAA(n)$_{34-38}$TA(n)$_2$TTTG (SEQ ID: 70), or comprising SEQ ID NO: 68, SEQ ID NO: 69, or SEQ ID NO: 71.

These and other aspects and features of the disclosure are described in the following detailed description and claims.

DESCRIPTION OF THE DRAWINGS

The disclosure can be more completely understood with reference to the following drawings.

DETAILED DESCRIPTION

The human gut, specifically the colon, is known to be permeable to oxalate. It functions as the primary site of absorption of dietary oxalate, and it is thought that secretion of oxalate out of the bloodstream and into the intestinal lumen provides a secondary route for elimination of oxalate from the body. Thus, the colon is an attractive location for a system to degrade oxalate, preventing absorption of dietary oxalate and reabsorption of secreted endogenous oxalate.

The disclosure relates generally to bacteria that have been modified to have increased oxalate degrading activity. For example, in one aspect, provided herein is a commensal bacterium that has been modified to have increased oxalate degrading activity relative to a similar or otherwise identical bacterium that has not been modified. It is contemplated that disclosed bacteria may, upon administration to a subject, break down oxalate in the subject, e.g., in the large intestine of the subject, and therefore be useful for treating a disorder associated with an elevated amount of oxalate in the subject, e.g., hyperoxaluria. Accordingly, the disclosure further relates to pharmaceutical compositions or units and methods of using disclosed bacteria to treat disorders associated with an elevated amount of oxalate, e.g., hyperoxaluria.

A contemplated modified bacteria may additionally have the ability to utilize a carbon source, such as the marine polysaccharide porphyrin, that other bacteria in the gut of a subject to be treated are largely unable to utilize. As a result, the proliferation, abundance, or stability of the modified bacteria in the gut of the subject may be maintained by supplying it with the carbon source.

I. Modified Bacteria

Figure 1:
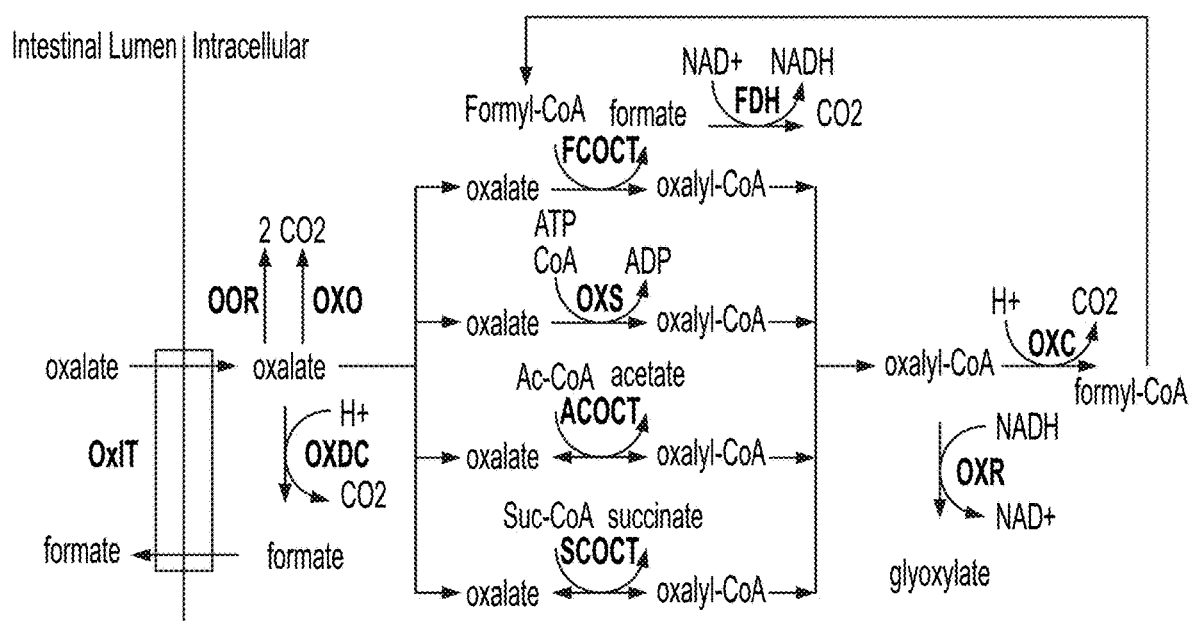
FIG. 1 is a schematic depicting pathways for oxalate degradation. Oxalate is imported into bacterial cells using the OxlT oxalate:formate antiporter and then converted into formate, glyoxylate, or $CO_2$ via a variety of different pathways. The most productive pathway uses OXS, FCOCT, ACOCT, or SCOCT to conjugate oxalate to CoA to make oxalyl-CoA, and then OXC to decarboxylate oxalyl-CoA into formyl-CoA. FCOCT is then used to release formate and restart the cycle.

The disclosure relates generally to bacteria that have been modified to have increased oxalate degrading activity relative to a similar or otherwise identical bacterium that has not been modified. For example, a contemplated bacterium may be modified to express one or more transgenes that increase oxalate degrading activity. The term "oxalate degrading" is used interchangeably with the term "oxalate consuming" herein. Pathways for oxalate degradation, including genes related to oxalate degradation, are depicted in FIG. 1. It is contemplated that the one or more transgenes may, e.g., be on a plasmid, bacterial artificial chromosome, or be genomically integrated. When a bacterium comprises one or more transgenes encoding multiple proteins, it is contemplated that the open reading frames encoding two or more of the proteins may, e.g., be present in a single operon.

Exemplary genes related to oxalate degradation, the expression of which in a bacterium may increase oxalate degrading activity, include those encoding: an oxalate:formate antiporter (OxlT); an oxalate decarboxylase (OXDC)—EC 4.1.1.2; an oxalate oxidase (OXO)—EC 1.2.3.4; an oxalate oxidoreductase (OOR)—EC 1.2.7.10; an oxalate-CoA ligase/Oxalyl-CoA synthetase (OXS)—EC 6.2.1.8; a formyl-CoA:oxalate CoA-transferase (FCOCT)—EC 2.8.3.16; an acetyl-CoA:oxalate CoA-transferase (ACOCT)—EC 2.8.3.19; a succinyl-CoA:oxalate CoA-transferase (SCOCT)—EC 2.8.3.2; an oxalyl-CoA decarboxylase (OXC)—EC 4.1.1.8; and an oxalyl-CoA reductase/glyoxylate:NADP+oxidoreductase (OXR)—EC 1.2.1.17.

In order for a bacterium to degrade oxalate, expression of an oxalate transporter may be required, typically an oxalate:formate antiporter. Exemplary oxalate transporters include OxlT from *Oxalobacter formigenes* or any of its homologs from other species including *Cupriavidus oxalaticus*, and *Bifidobacterium animalis* subsp. *lactis*. These antiporters bring oxalate into the bacterial cell from the intestinal environment, and, in exchange, expel one molecule of formate waste for every molecule of oxalate brought in. Once the oxalate gets into the cell, it can be directly degraded using oxalate decarboxylase (OXDC)—EC 4.1.1.2, oxalate oxidase (OXO)—EC 1.2.3.4, or oxalate oxidoreductase (OOR)—EC 1.2.7.10.

Alternatively, the oxalate can be conjugated to coenzyme A to make oxalyl-CoA using either oxalate-CoA ligase (OXS)—EC 6.2.1.8, formyl-CoA:oxalate CoA-transferase (FCOCT)—EC 2.8.3.16, acetyl-CoA:oxalate CoA-transferase (ACOCT)—EC 2.8.3.19, or succinyl-CoA:oxalate CoA-transferase (SCOCT)—EC 2.8.3.2. FCOCT uses formyl-CoA as a CoA donor, and as formyl-CoA is generated as a waste product during oxalyl-CoA degradation, results in an efficient cycle. It may also be necessary to start the cycle using more abundant starting material such as ATP, acetyl-CoA, or succinyl-CoA, used by OXS, ACOCT, and SCOCT respectively.

Oxalyl-CoA is broken down by oxalyl-CoA decarboxylase (OXC)—EC 4.1.1.8. This in turn generates formyl-CoA, which is degraded by FCOCT to release formate. Then formate can be degraded by formate dehydrogenase (FDH)—EC 1.2.1.2 to generate $CO_2$. An additional option for oxalyl-CoA disposal is reduction into glyoxylate for constructing additional biomass via oxalyl-CoA reductase (OXR)/Glyoxylate:NADP+oxidoreductase—EC 1.2.1.17.

In certain embodiments of a contemplated modified bacterium, oxalate is imported into the bacterium using an OxIT antiporter and fed into a continuous cycle of oxalate to formate conversion using FCOCT and OXC. Further support for this cycle can be provided by increased expression of multiple copies of OXC enzymes. Additionally, the pool of cycle intermediates, oxalyl-CoA and formyl-CoA, can be created and supported by expression of OXS, ACOCT, or SCOCT. Thus, in certain embodiments, a contemplated bacterial cell has high, multicopy expression of OXC and FCOCT, high expression of OXS, ACOCT, and/or SCOCT, and moderate expression of OxIT. In certain embodiments, an N-terminal fragment of an oxalate:formate antiporter has been swapped with an N-terminal fragment from a native transporter protein.

Accordingly, in certain embodiments, a contemplated bacterium comprises one or more transgenes encoding an OxIT or a functional fragment or variant thereof, an OXS or a functional fragment or variant thereof, and an OXC or a functional fragment or variant thereof. In certain embodiments, a bacterium further comprises one or more transgenes encoding a FCOCT or a functional fragment or variant thereof and/or an ACOCT or a functional fragment or variant thereof.

In certain embodiments, a contemplated bacterium comprises one or more transgenes encoding an OxIT or a functional fragment or variant thereof, an OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof. In certain embodiments, a contemplated bacterium comprises one or more transgenes encoding an OxIT or a functional fragment or variant thereof, a first OXS or a functional fragment or variant thereof, a second OXS or a functional fragment or variant thereof, an OXC or a functional fragment or variant thereof, a FCOCT or a functional fragment or variant thereof, and/or an ACOCT or a functional fragment or variant thereof. In certain embodiments, a contemplated bacterium comprises one or more transgenes encoding an OxIT or a functional fragment or variant thereof, a first OXS or a functional fragment or variant thereof, a second OXS or a functional fragment or variant thereof, a first OXC or a functional fragment or variant thereof, a second OXC or a functional fragment or variant thereof, a FCOCT or a functional fragment or variant thereof, and/or an ACOCT or a functional fragment or variant thereof.

As used herein, the term "functional fragment" of a biological entity (e.g., a gene, protein (e.g., OxIT, OXS, OXC, or FCOCT), promoter, or ribosome binding site) refers to a fragment of the full-length biological entity that retains, for example, at least 10%, at least 20%, at least 30%, at least 40%, at least 50%, at least 60%, at least 70%, at least 80%, at least 90%, or 100% of the biological activity of the corresponding full-length, naturally occurring biologically entity.

In certain embodiments, a contemplated bacterium comprises one or more transgenes encoding a *B. animalis* subsp. *lactis* OxIT, e.g., a *B. animalis* subsp. *lactis* DSM 10140 OxIT, a *C. oxalaticus* OxIT, e.g., a *C. oxalaticus* ATCC 11883 OxIT, an *E. coli* OxIT, e.g., an *E. coli* MG1655 OxIT, an *O. formigenes* OxIT, e.g., an *O. formigenes* DSM 4420 OxIT, or a functional fragment or variant of any of the foregoing proteins. For example, in certain embodiments, a contemplated bacterium comprises one or more transgenes encoding an *O. formigenes* OxIT, e.g., an *O. formigenes* DSM 4420 OxIT, or a protein having at least 80%, 85%, 86%, 87%, 88%, 89%, 90%, 91%, 92%, 93%, 94%, 95%, 96%, 97%, 98%, or 99% identity to an *O. formigenes* OxIT.

In certain embodiments, a contemplated bacterium comprises one or more transgenes encoding a *S. cerevisiae* OXS, e.g., a *S. cerevisiae* S288C OXS, a *M. extorquens* OXS, e.g., a *M. extorquens* AM1/DSM 1338 OXS, an *A. thaliana* OXS, e.g., an *A. thaliana* col-1 OXS, or a functional fragment or variant of any of the foregoing proteins. For example, in certain embodiments, a contemplated bacterium comprises one or more transgenes encoding a *S. cerevisiae* OXS, e.g., a *S. cerevisiae* S288C OXS, or a protein having at least 80%, 85%, 86%, 87%, 88%, 89%, 90%, 91%, 92%, 93%, 94%, 95%, 96%, 97%, 98%, or 99% identity to a *S. cerevisiae* OXS. In certain embodiments, a contemplated bacterium comprises one or more transgenes encoding an *A. thaliana* OXS, e.g., an *A. thaliana* col-1 OXS, or a protein having at least 80%, 85%, 86%, 87%, 88%, 89%, 90%, 91%, 92%, 93%, 94%, 95%, 96%, 97%, 98%, or 99% identity to an *A. thaliana* OXS.

In certain embodiments, a contemplated bacterium comprises one or more transgenes encoding a *B. animalis* subsp. *lactis* OXC, e.g., a *B. animalis* subsp. *lactis* DSM 10140 OXC, a *C. oxalaticus* OXC, e.g., a *C. oxalaticus* ATCC 11883 OXC, an *E. coli* OXC, e.g., an *E. coli* MG1655 OXC, a *S. cerevisiae* OXC, e.g., a *S. cerevisiae* S288C OXC, an *O. formigenes* OXC, e.g., an *O. formigenes* DSM 4420 OXC, or a functional fragment or variant of any of the foregoing proteins. For example, in certain embodiments, a contemplated bacterium comprises one or more transgenes encoding a *S. cerevisiae* OXC, e.g., a *S. cerevisiae* S288C OXC, or a protein having at least 80%, 85%, 86%, 87%, 88%, 89%, 90%, 91%, 92%, 93%, 94%, 95%, 96%, 97%, 98%, or 99% identity to a *S. cerevisiae* OXC. In certain embodiments a contemplated bacterium comprises one or more transgenes encoding an *O. formigenes* OXC, e.g., an *O. formigenes* DSM 4420 OXC, or a protein having at least 80%, 85%, 86%, 87%, 88%, 89%, 90%, 91%, 92%, 93%, 94%, 95%, 96%, 97%, 98%, or 99% identity to an *O. formigenes* OXC.

In certain embodiments, a contemplated bacterium comprises one or more transgenes encoding a *B. animalis* subsp. *lactis* FCOCT, e.g., a *B. animalis* subsp. *lactis* DSM 10140 FCOCT, a *C. oxalaticus* FCOCT, e.g., a *C. oxalaticus* ATCC 11883 FCOCT, an *E. coli* FCOCT, e.g., an *E. coli* MG1655 FCOCT, an *O. formigenes* FCOCT, e.g., an *O. formigenes* DSM 4420 FCOCT, or a functional fragment or variant of any of the foregoing proteins. For example, in certain embodiments, a contemplated bacterium comprises one or more transgenes encoding an *E. coli* FCOCT, e.g., an *E. coli* MG1655 FCOCT, or a protein having at least 80%, 85%, 86%, 87%, 88%, 89%, 90%, 91%, 92%, 93%, 94%, 95%, 96%, 97%, 98%, or 99% identity to an *E. coli* FCOCT.

In certain embodiments, a contemplated bacterium comprises one or more transgenes encoding an *A. aceti* ACOCT, e.g., an *A. aceti* strain 1023 ACOCT, an *E. coli* ACOCT, e.g., an *E. coli* MG1655 ACOCT, or a functional fragment or variant of any of the foregoing proteins. For example, in certain embodiments, a contemplated bacterium comprises one or more transgenes encoding an *E. coli* ACOCT, e.g., an *E. coli* MG1655 ACOCT, or a protein having at least 80%, 85%, 86%, 87%, 88%, 89%, 90%, 91%, 92%, 93%, 94%, 95%, 96%, 97%, 98%, or 99% identity to an *E. coli* ACOCT.

For example, it is contemplated that a bacterium may comprise: (i) one or more transgenes encoding a *S. cerevisiae* OXS, a *S. cerevisiae* OXC, and an *O. formigenes* OxIT, or a functional fragment or variant of any of the foregoing proteins; (ii) one or more transgenes encoding an *E. coli* FCOCT, an *O. formigenes* OXC, a *S. cerevisiae* OXS, and an *O. formigenes* OxIT, or a functional fragment or variant of any of the foregoing proteins; (iii) one or more transgenes encoding an *E. coli* FCOCT, an *O. formigenes* OXC, a *S. cerevisiae* OXS, a *S. cerevisiae* OXC, an *E. coli* ACOCT, and an *O. formigenes* OxIT, or a functional fragment or variant of any of the foregoing proteins; (iv) one or more transgenes encoding an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT, or a functional fragment or variant of any of the foregoing proteins; (v) one or more transgenes encoding an *E. coli* FCOCT, an *O. formigenes* OXC, an *O. formigenes* OxIT, an *E. coli* ACOCT, and a *S. cerevisiae* OXS, or a functional fragment or variant of any of the foregoing proteins; (vi) one or more transgenes encoding an *O. formigenes* OxIT, an *E. coli* FCOCT, a *S. cerevisiae* OXC, an *E. coli* ACOCT, a *S. cerevisiae* OXS, and an *A. thaliana* OXS, or a functional fragment or variant of any of the foregoing proteins; or (vii) one or more transgenes encoding an *O. formigenes* OxIT, an *E. coli* FCOCT, a *S. cerevisiae* OXC, an *E. coli* ACOCT, and a *S. cerevisiae* OXS, or a functional fragment or variant of any of the foregoing proteins.

Exemplary ACOCT coding sequences are depicted in SEQ ID NOs: 1-2, exemplary FDH coding sequences are depicted in SEQ ID NOs: 3-4, exemplary FCOCT coding sequences are depicted in SEQ ID NOs: 4-8, an exemplary OXDC coding sequence is depicted in SEQ ID NO: 9, an exemplary OXO coding sequence is depicted in SEQ ID NO: 10, exemplary OOR coding sequence are depicted in SEQ ID NOs: 11-13, exemplary OXS coding sequences are depicted in SEQ ID NOs: 14-16, exemplary OxIT coding sequences are depicted in SEQ ID NOs: 17-21, exemplary OXC coding sequences are depicted in SEQ ID NOs: 22-26 and 163, an exemplary OXR coding sequence is depicted in SEQ ID NO: 27, and exemplary SCOCT coding sequences are depicted in SEQ ID NOs: 28-31.

Accordingly, in certain embodiments, a bacterium has been modified to comprise one or more nucleic acids comprising a nucleotide sequence of any one of SEQ ID NOs: 1-31, or a functional fragment or variant thereof. In certain embodiments, a bacterium has been modified to comprise one or more nucleic acids comprising a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 1-31, or a functional fragment or variant thereof.

For example, it is contemplated that a bacterium may comprise one or more nucleic acids comprising the nucleotide sequences of SEQ ID NO: 16, SEQ ID NO: 26 or SEQ ID NO: 163, and SEQ ID NO: 21, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 16, SEQ ID NO: 26 or SEQ ID NO: 163, and SEQ ID NO: 21. It is contemplated that a bacterium may comprise one or more nucleic acids comprising the nucleotide sequences of SEQ ID NO: 7, SEQ ID NO: 25, SEQ ID NO: 16, and SEQ ID NO: 21, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 7, SEQ ID NO: 25, SEQ ID NO: 16, and SEQ ID NO: 21. It is contemplated that a bacterium may comprise one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 2, and SEQ ID NO: 21, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 7, SEQ ID NO: 25, SEQ ID NO: 16, SEQ ID NO: 26 or SEQ ID NO: 163, SEQ ID NO: 2, and SEQ ID NO: 21. It is contemplated that a bacterium may comprise one or more nucleic acids comprising the nucleotide sequences of SEQ ID NO: 7, SEQ ID NO: 25, SEQ ID NO: 16, SEQ ID NO: 26 or SEQ ID NO: 163, SEQ ID NO: 14, SEQ ID NO: 2, and SEQ ID NO: 21, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 7, SEQ ID NO: 25, SEQ ID NO: 16, SEQ ID NO: 26 or SEQ ID NO: 163, SEQ ID NO: 14, SEQ ID NO: 2, and SEQ ID NO: 21. It is contemplated that a bacterium may comprise one or more nucleic acids comprising the nucleotide sequences of SEQ ID NO: 7, SEQ ID NO: 25, SEQ ID NO: 21, SEQ ID NO: 2, and SEQ ID NO: 16, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 7, SEQ ID NO: 25, SEQ ID NO: 21, SEQ ID NO: 2, and SEQ ID NO: 16. It is contemplated that a bacterium may comprise one or more nucleic acids comprising the nucleotide sequences of SEQ ID NO: 21, SEQ ID NO: 7, SEQ ID NO: 26 or SEQ ID NO: 163, SEQ ID NO: 2, SEQ ID NO: 16, and SEQ ID NO: 14, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 21, SEQ ID NO: 7, SEQ ID NO: 26 or SEQ ID NO: 163, SEQ ID NO: 2, SEQ ID NO: 16, and SEQ ID NO: 14. It is contemplated that a bacterium may comprise one or more nucleic acids comprising the nucleotide sequences of SEQ ID NO: 21, SEQ ID NO: 7, SEQ ID NO: 26 or SEQ ID NO: 163, SEQ ID NO: 2, and SEQ ID NO: 16, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 21, SEQ ID NO: 7, SEQ ID NO: 26 or SEQ ID NO: 163, SEQ ID NO: 2, and SEQ ID NO: 16.

In certain embodiments, a bacterium has been modified to comprise one or more nucleic acids comprising a nucleotide sequence encoding an amino acid sequence of any one of SEQ ID NOs: 32-62, or a functional fragment or variant thereof. In certain embodiments, a bacterium has been modified to comprise one or more nucleic acids comprising a nucleotide sequence encoding an amino acid sequence having at least 80%, 85%, 86%, 87%, 88%, 89%, 90%, 91%, 92%, 93%, 94%, 95%, 96%, 97%, 98%, or 99% identity to any one of SEQ ID NOs: 32-62, or a functional fragment or variant thereof.

For example, it is contemplated that a bacterium may comprise one or more nucleic acids comprising one or more nucleotide sequences encoding the amino acid sequences of SEQ ID NO: 47, SEQ ID NO: 57, and SEQ ID NO: 52, or amino acid sequences having at least 80%, 85%, 86%, 87%, 88%, 89%, 90%, 91%, 92%, 93%, 94%, 95%, 96%, 97%, 98%, or 99% identity to SEQ ID NO: 47, SEQ ID NO: 57, and SEQ ID NO: 52. It is contemplated that a bacterium may comprise one or more nucleic acids comprising one or more nucleotide sequences encoding the amino acid sequences of SEQ ID NO: 38, SEQ ID NO: 56, SEQ ID NO: 47, and SEQ ID NO: 52, or amino acid sequences having at least 80%, 85%, 86%, 87%, 88%, 89%, 90%, 91%, 92%, 93%, 94%, 95%, 96%, 97%, 98%, or 99% identity to SEQ ID NO: 38, SEQ ID NO: 56, SEQ ID NO: 47, and SEQ ID NO: 52. It is contemplated that a bacterium may comprise one or more nucleic acids comprising one or more nucleotide sequences encoding the amino acid sequences of SEQ ID NO: 38, SEQ ID NO: 56, SEQ ID NO: 47, SEQ ID NO: 57, SEQ ID NO: 33, and SEQ ID NO: 52, or amino acid sequences having at least 80%, 85%, 86%, 87%, 88%, 89%, 90%, 91%, 92%, 93%, 94%, 95%, 96%, 97%, 98%, or 99% identity to SEQ ID NO: 38, SEQ ID NO: 56, SEQ ID NO: 47, SEQ ID NO: 57, SEQ ID NO: 33, and SEQ ID NO: 52. It is contemplated that a bacterium may comprise one or more nucleic acids comprising one or more nucleotide sequences encoding the amino acid sequences of SEQ ID NO: 38, SEQ ID NO: 56, SEQ ID NO: 47, SEQ ID NO: 57, SEQ ID NO: 45, SEQ ID NO: 33, and SEQ ID NO: 52, or amino acid sequences having at least 80%, 85%, 86%, 87%, 88%, 89%, 90%, 91%, 92%, 93%, 94%, 95%, 96%, 97%, 98%, or 99% identity to SEQ ID NO: 38, SEQ ID NO: 56, SEQ ID NO: 47, SEQ ID NO: 57, SEQ ID NO: 45, SEQ ID NO: 33, and SEQ ID NO: 52. It is contemplated that a bacterium may comprise one or more nucleic acids comprising one or more nucleotide sequences encoding the amino acid sequences of SEQ ID NO: 38, SEQ ID NO: 56, SEQ ID NO: 52, SEQ ID NO: 33, and SEQ ID NO: 47, or amino acid sequences having at least 80%, 85%, 86%, 87%, 88%, 89%, 90%, 91%, 92%, 93%, 94%, 95%, 96%, 97%, 98%, or 99% identity to SEQ ID NO: 38, SEQ ID NO: 56, SEQ ID NO: 52, SEQ ID NO: 33, and SEQ ID NO: 47. It is contemplated that a bacterium may comprise one or more nucleic acids comprising one or more nucleotide sequences encoding the amino acid sequences of SEQ ID NO: 52, SEQ ID NO: 38, SEQ ID NO: 57, SEQ ID NO: 33, SEQ ID NO: 47, and SEQ ID NO: 45, or amino acid having at least 80%, 85%, 86%, 87%, 88%, 89%, 90%, 91%, 92%, 93%, 94%, 95%, 96%, 97%, 98%, or 99% identity to SEQ ID NO: 52, SEQ ID NO: 38, SEQ ID NO: 57, SEQ ID NO: 33, SEQ ID NO: 47, and SEQ ID NO: 45. It is contemplated that a bacterium may comprise one or more nucleic acids comprising one or more nucleotide sequences encoding the amino acid sequences of SEQ ID NO: 52, SEQ ID NO: 38, SEQ ID NO: 57, SEQ ID NO: 33, and SEQ ID NO: 47, or amino acid sequences having at least 80%, 85%, 86%, 87%, 88%, 89%, 90%, 91%, 92%, 93%, 94%, 95%, 96%, 97%, 98%, or 99% identity to SEQ ID NO: 52, SEQ ID NO: 38, SEQ ID NO: 57 SEQ ID NO: 33, and SEQ ID NO: 47.

Sequence identity may be determined in various ways that are within the skill in the art, e.g., using publicly available computer software such as BLAST, BLAST-2, ALIGN or Megalign (DNASTAR) software. BLAST (Basic Local Alignment Search Tool) analysis using the algorithm employed by the programs blastp, blastn, blastx, tblastn and tblastx (Karlin et al., (1990) PROC. NATL. ACAD. SCI. USA 87:2264-2268; Altschul, (1993) J. MOL. EVOL. 36, 290-300; Altschul et al., (1997) NUCLEIC ACIDS RES. 25:3389-3402, incorporated by reference) are tailored for sequence similarity searching. For a discussion of basic issues in searching sequence databases see Altschul et al., (1994) NATURE GENETICS 6:119-129, which is fully incorporated by reference. Those skilled in the art can determine appropriate parameters for measuring alignment, including any algorithms needed to achieve maximal alignment over the full length of the sequences being compared. The search parameters for histogram, descriptions, alignments, expect (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., (1992) PROC. NATL. ACAD. SCI. USA 89:10915-10919, fully incorporated by reference). Four blastn parameters may be adjusted as follows: Q=10 (gap creation penalty); R=10 (gap extension penalty); wink=1 (generates word hits at every wink.sup.th position along the query); and gapw=16 (sets the window width within which gapped alignments are generated). The equivalent Blastp parameter settings may be Q=9; R=2; wink=1; and gapw=32. Searches may also be conducted using the NCBI (National Center for Biotechnology Information) BLAST Advanced Option parameter (e.g.: -G, Cost to open gap [Integer]: default=5 for nucleotides/11 for proteins; -E, Cost to extend gap [Integer]: default=2 for nucleotides/1 for proteins; -q, Penalty for nucleotide mismatch [Integer]: default=-3; -r, reward for nucleotide match [Integer]: default=1; -e, expect value [Real]: default=10; -W, wordsize [Integer]: default=11 for nucleotides/28 for megablast/3 for proteins; -y, Dropoff (X) for blast extensions in bits: default=20 for blastn/7 for others; -X, X dropoff value for gapped alignment (in bits): default=15 for all programs, not applicable to blastn; and Z, final X dropoff value for gapped alignment (in bits): 50 for blastn, 25 for others). ClustalW for pairwise protein alignments may also be used (default parameters may include, e.g., Blosum62 matrix and Gap Opening Penalty=10 and Gap Extension Penalty=0.1). A Bestfit comparison between sequences, available in the GCG package version 10.0, uses DNA parameters GAP=50 (gap creation penalty) and LEN=3 (gap extension penalty) and the equivalent settings in protein comparisons are GAP=8 and LEN=2.

A contemplated modified bacterium, for example, for use in a disclosed pharmaceutical composition or method, includes a bacterium of genus *Bacteroides, Alistipes, Faecalibacterium, Parabacteroides, Prevotella, Roseburia, Ruminococcus, Clostridium, Oscillibacter, Gemmiger, Barnesiella, Dialister, Parasutterella, Phascolarctobacterium, Propionibacterium, Sutterella, Blautia, Paraprevotella, Coprococcus, Odoribacter, Spiroplasma, Anaerostipes*, or *Akkermansia*. A contemplated bacterium, for example, for use in a disclosed pharmaceutical composition or method, may be of the *Bacteroides* genus, i.e., may be a *Bacteroides* species bacterium.

Exemplary *Bacteroides* species include *B. acidifaciens, B. barnesiaes, B. caccae, B. caecicola, B. caecigallinarum, B. cellulosilyticus, B. cellulosolvens, B. clarus, B. coagulans, B. coprocola, B. coprophilus, B. coprosuis, B. distasonis, B. dorei, B. eggerthii, B. gracilis, B. faecichinchillae, B. faecis, B. fine goldii, B. fluxus, B. fragilis, B. galacturonicus, B. gallinaceum, B. gallinarum, B. goldsteinii, B. graminisolvens, B. helco gene, B. intestinalis, B. luti, B. massiliensis,*

*B. melaninogenicus, B. nordii, B. oleiciplenus, B. oris, B. ovatus, B. paurosaccharolyticus, B. pectinophilus, B. plebeius, B. polypragmatus, B. propionicifaciens, B. putredinis, B. pyogenes, B. reticulotermitis, B. rodentium, B. salanitronis, B. salyersiae, B. sartorii, B. sediment B. stercoris, B. suis, B. tectus, B. thetaiotaomicron, B. uniformis, B. vulgatus, B. xylanisolvens,* and *B. xylanolyticusxylanolyticus.*

As used herein, the term "species" refers to a taxonomic entity as conventionally defined by genomic sequence and phenotypic characteristics. A "strain" is a particular instance of a species that has been isolated and purified according to conventional microbiological techniques. The present disclosure encompasses derivatives of the disclosed bacterial strains. The term "derivative" includes daughter strains (progeny) or stains cultured (sub-cloned) from the original but modified in some way (including at the genetic level), without altering negatively a biological activity of the strain.

Figure 2:
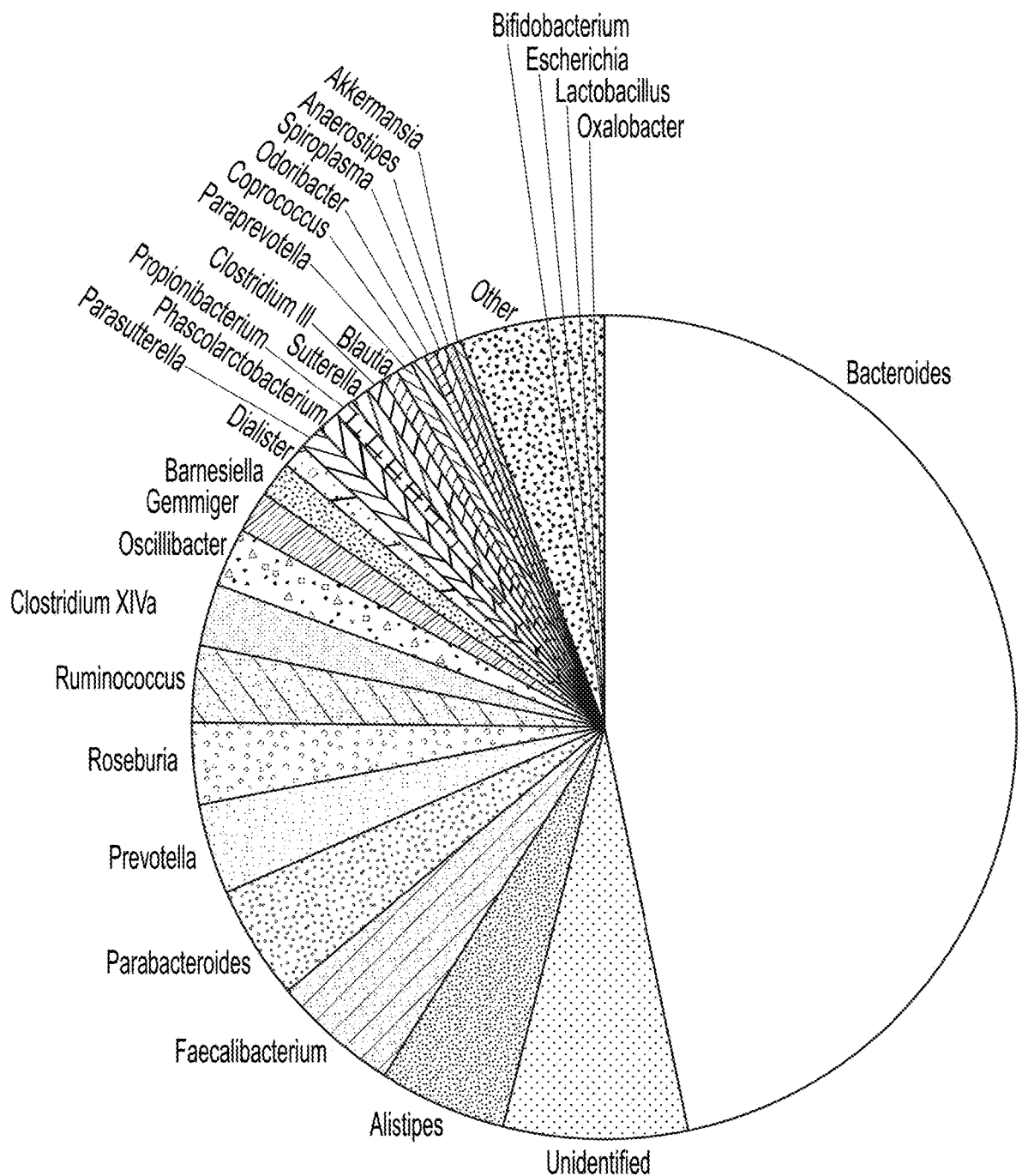
FIG. 2 is a pie chart showing bacterial abundance in the average human gut based on 16S ribosomal DNA sequencing. *Bacteroides* is the most abundant genus at 46%.

In certain embodiments, a contemplated modified bacterium is of a genus that makes up more than 0.1%, 0.5%, 1%, 5%, 10%, 20%, 30%, or 40% of the total culturable microbes in the feces of a subject to be treated, or in the feces of an average human. In certain embodiments, a contemplated modified bacterium is of a genus that is detected at a level greater than $10^{12}$, $10^{11}$, $10^{10}$, $10^9$, $10^8$, $10^7$ colony forming units per gram of feces of a subject to be treated, or per gram of feces of an average human. In certain embodiments, a contemplated modified bacterium is of a genus that makes up more than 0.1%, 0.5%, 1%, 5%, 10%, 20%, 30%, or 40% of the gut microbiome of a subject to be treated, or of the gut microbiome of an average human. Human gut or feces microbiome composition may be assayed by any technique known in the art, including 16S ribosomal sequencing. FIG. 2 shows bacterial abundance in the average human gut based on 16S ribosomal DNA sequencing. *Bacteroides* is the most naturally abundant genus in the human gut.

rRNA, 16S rDNA, 16S rRNA, 16S, 18S, 18S rRNA, and 18S rDNA refer to nucleic acids that are components of, or encode for, components of the ribosome. There are two subunits in the ribosome termed the small subunit (SSU) and large subunit (LSU). rDNA genes and their complementary RNA sequences are widely used for determination of the evolutionary relationships amount organisms as they are variable, yet sufficiently conserved to allow cross-organism molecular comparisons.

16S rDNA sequence (approximately 1542 nucleotides in length) of the 30S SSU can be used, in certain embodiments, for molecular-based taxonomic assignments of prokaryotes and the 18S rDNA sequence (approximately 1869 nucleotides in length) of 40S SSU may be used for eukaryotes. For example, 16S sequences may be used for phylogenetic reconstruction as they are general highly conserved but contain specific hypervariable regions that harbor sufficient nucleotide diversity to differentiate genera and species of most bacteria. Although 16S rDNA sequence data has been used to provide taxonomic classification, closely related bacterial strains that are classified within the same genus and species, may exhibit distinct biological phenotypes.

The identity of contemplated bacterial species or strains may be characterized by 16S rRNA or full genome sequence analysis. For example, in certain embodiments, contemplated bacterial strains may comprise a 16S rRNA or genomic sequence having a certain % identity to a reference sequence.

In certain embodiments, a contemplated modified bacterium is capable of stably colonizing the human gut. A disclosed bacterium may, e.g., upon administration to a human subject, result in an abundance greater than $10^{12}$, $10^{11}$, $10^{10}$, $10^9$, $10^8$, or $10^7$ cfu per gram of fecal content. For example, administration of about $10^3$, about $10^4$, about $10^5$, about $10^6$, about $10^7$, about $10^8$, about $10^9$, about $10^{10}$, about $10^{11}$, or about $10^{12}$ cells of a disclosed bacterium to a human subject may result in an abundance greater than $10^{12}$, $10^{11}$, $10^{10}$, $10^9$, $10^8$, or $10^7$ cfu per gram of fecal content with 12 hours, 24 hours, 36 hours, 48 hours, 60 hours, or 72 hours of administration.

A disclosed bacterium may, e.g., have been modified to colonize the human gut with increased abundance, stability, predictability or ease of initial colonization relative to a similar or otherwise identical bacterium that has not been modified. For example, a contemplated bacterium may be modified to increase its ability to utilize a privileged nutrient as carbon source. A "privileged nutrient" is defined as a molecule or set of molecules that can be consumed to aid in the proliferation of a particular bacterial strain while providing proliferation assistance to no more than 1% of the other bacteria in the gut. Accordingly, in certain embodiments, a modified bacterium has the ability to consume the privileged nutrient to sustain its colonization and expand in the gut of a subject to a predictably high abundance, even in the absence of oxalate or other carbon or energy sources, while most other bacteria in the gut of the subject do not. Exemplary privileged nutrients include, e.g., a marine polysaccharide, e.g., a porphyran.

For example, a bacterium may comprise one or more transgenes that increase its ability to utilize a privileged nutrient, e.g., a marine polysaccharide, e.g., a porphyrin, as carbon source. In certain embodiments, a bacterium may comprise all or a portion of a polysaccharide utilization locus (PUL), a mobile genetic element that confers the ability to consume a carbohydrate, e.g., a privileged nutrient, upon a bacterium. An exemplary porphyran consumption PUL is the PUL from the porphyran-consuming *Bacteroides* strain NB001 depicted in SEQ ID NO: 72. Accordingly, in certain embodiments, a modified bacterium comprises SEQ ID NO: 72, or a functional fragment or variant thereof. In certain embodiments, a modified bacterium comprises a nucleotide sequence having at least 80%, 85%, 86%, 87%, 88%, 89%, 90%, 91%, 92%, 93%, 94%, 95%, 96%, 97%, 98%, or 99% identity to SEQ ID NO: 72, or a functional fragment or variant thereof.

Additional exemplary bacterial modifications to increase abundance in the gut of a subject, privileged nutrients, transgenes that increase the ability of a bacteria to utilize a privileged nutrient, PULs, and other methods and compositions for modulating the growth of a modified bacterium are described in International (PCT) Patent Publication No. WO2018112194.

In certain embodiments, a similar or otherwise identical bacterium that has not been modified has no detectable oxalate degrading activity and/or has no genes known to be involved e.g., directly involved, in oxalate catabolism. For example, a similar or otherwise identical bacterium that has not been modified may have no genes encoding: an oxalate:formate antiporter (OxlT); an oxalate decarboxylase (OXDC)—EC 4.1.1.2; an oxalate oxidase (OXO)—EC 1.2.3.4; an oxalate oxidoreductase (OOR)—EC 1.2.7.10; an oxalate-CoA ligase/Oxalyl-CoA synthetase (OXS)—EC 6.2.1.8; a formyl-CoA:oxalate CoA-transferase (FCOCT)—EC 2.8.3.16; an acetyl-CoA:oxalate CoA-transferase (ACOCT)—EC 2.8.3.19; a succinyl-CoA:oxalate CoA-transferase (SCOCT)—EC 2.8.3.2; an oxalyl-CoA decarboxylase (OXC)—EC 4.1.1.8; or an oxalyl-CoA reductase/glyoxylate:NADP+oxidoreductase (OXR)—EC 1.2.1.17. In certain embodiments, no naturally occurring member of the same genus as the bacterium has detectable oxalate degrading activity.

In certain embodiments, a disclosed transgene or nucleic acid comprising an exogenous nucleotide sequence is operably linked to at least one constitutive promoter, e.g., a phage-derived promoter. The term "operably linked" refers to a linkage of polynucleotide elements in a functional relationship. A nucleic acid sequence is "operably linked" when it is placed into a functional relationship with another nucleic acid sequence. For instance, a promoter or enhancer is operably linked to a gene if it affects the transcription of the gene. Operably linked nucleotide sequences are typically contiguous. However, as enhancers generally function when separated from the promoter by several kilobases and intronic sequences may be of variable lengths, some polynucleotide elements may be operably linked but not directly flanked and may even function in trans from a different allele or chromosome. Exemplary phage-derived promoters include those comprising the nucleotide sequence of SEQ ID NO: 68, SEQ ID NO: 69, SEQ ID NO: 70, or SEQ ID NO: 71, or a nucleotide sequence having at least 80%, 85%, 86%, 87%, 88%, 89%, 90%, 91%, 92%, 93%, 94%, 95%, 96%, 97%, 98%, or 99% identity to SEQ ID NO: 68, SEQ ID NO: 69, SEQ ID NO: 70, or SEQ ID NO: 71. Additional exemplary phage-derived promoters are described in International (PCT) Patent Publication No. WO2017184565.

In certain embodiments, a disclosed transgene or nucleic acid comprising an exogenous nucleotide sequence is operably linked to at least one ribosome binding site (RBS). Exemplary RBSs include those comprising the nucleotide sequence of any one of SEQ ID NOs: 164-230, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 164-230, or a functional fragment or variant of any of the foregoing nucleotide sequences. For example, a contemplated bacterium may comprise: (i) a transgene encoding an *O. formigenes* OxlT operably linked to an RBS comprising the nucleotide sequence of any one of SEQ ID NOs: 212-219, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 212-219, or a functional fragment or variant of any of the foregoing nucleotide sequences; (ii) a transgene encoding a *S. cerevisiae* OXS operably linked to an RBS comprising the nucleotide sequence of any one of SEQ ID NOs: 172-179, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 172-179, or a functional fragment or variant of any of the foregoing nucleotide sequences; (iii) a transgene encoding an *A. thaliana* OXS operably linked to an RBS comprising the nucleotide sequence of any one of SEQ ID NOs: 164-171, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 164-171, or a functional fragment or variant of any of the foregoing nucleotide sequences; (iv) a transgene encoding a *S. cerevisiae* OXC operably linked to an RBS comprising the nucleotide sequence of any one of SEQ ID NOs: 188-195 or 220-230, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 188-195 or 220-230, or a functional fragment or variant of any of the foregoing nucleotide sequences; (v) a transgene encoding an *O. formigenes* OXC operably linked to an RBS comprising the nucleotide sequence of any one of SEQ ID NOs: 180-187, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 180-187, or a functional fragment or variant of any of the foregoing nucleotide sequences; (vi) a transgene encoding an *E. coli* FCOCT operably linked to an RBS comprising the nucleotide sequence of any one of SEQ ID NOs: 204-211, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 204-211, or a functional fragment or variant of any of the foregoing nucleotide sequences; and/or (vii) transgene encoding an *E. coli* ACOCT operably linked to an RBS comprising the nucleotide sequence of any one of SEQ ID NOs: 196-203, a nucleotide sequence having at least 80%, 85%, 86%, 87%, 88%, 89%, 90%, 91%, 92%, 93%, 94%, 95%, 96%, 97%, 98%, or 99% identity to any one of SEQ ID NOs: 196-203, or a functional fragment or variant of any of the foregoing nucleotide sequences.

It is contemplated that a bacterium may comprise one or more nucleic acids comprising the nucleotide sequence of any one of SEQ ID NOs: 96-162, or a nucleotide sequence having at least 80%, 85%, 86%, 87%, 88%, 89%, 90%, 91%, 92%, 93%, 94%, 95%, 96%, 97%, 98%, or 99% identity to the nucleotide sequence of any one of SEQ ID NOs: 96-162.

For example, it is contemplated that a bacterium may comprise one or more nucleic acids comprising the nucleotide sequences of SEQ ID NO: 137, SEQ ID NO: 113, SEQ ID NO: 145, SEQ ID NO: 128, and SEQ ID NO: 104, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 137, SEQ ID NO: 113, SEQ ID NO: 145, SEQ ID NO: 128, and SEQ ID NO: 104. It is contemplated that a bacterium may comprise one or more nucleic acids comprising the nucleotide sequences of SEQ ID NO: 155, SEQ ID NO: 137, SEQ ID NO: 128, SEQ ID NO: 148, SEQ ID NO: 115, SEQ ID NO: 98, and SEQ ID NO: 105, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 155, SEQ ID NO: 137, SEQ ID NO: 128, SEQ ID NO: 148, SEQ ID NO: 115, SEQ ID NO: 98, and SEQ ID NO: 105. It is contemplated that a bacterium may comprise one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 155, SEQ ID NO: 137, SEQ ID NO: 128, SEQ ID NO: 144, SEQ ID NO: 115, SEQ ID NO: 98, and SEQ ID NO: 105. It is contemplated that a bacterium may comprise one or more nucleic acids comprising the nucleotide sequences of SEQ ID NO: 147, SEQ ID NO: 104, SEQ ID NO: 153, SEQ ID NO: 97, SEQ ID NO: 131, SEQ ID NO: 136, and SEQ ID NO: 113, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 147, SEQ ID NO: 104, SEQ ID NO: 153, SEQ ID NO: 97, SEQ ID NO: 131, SEQ ID NO: 136, and SEQ ID NO: 113. It is contemplated that a bacterium may comprise one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 145, SEQ ID NO: 137, SEQ ID NO: 153, SEQ ID NO: 129, SEQ ID NO: 105, SEQ ID NO: 113, and SEQ ID NO: 96. It is contemplated that a bacterium may comprise one or more nucleic acids Comprising the nucleotide sequences of SEQ ID NO: 145, SEQ ID NO: 137, SEQ ID NO: 153, SEQ ID NO: 129, SEQ ID NO: 105, and SEQ ID NO: 96, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 145, SEQ ID NO: 137, SEQ ID NO: 153, SEQ ID NO: 129, SEQ ID NO: 105, and SEQ ID NO: 96. It is contemplated that a bacterium may comprise one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 139, SEQ ID NO: 129, SEQ ID NO: 155, SEQ ID NO: 112, SEQ ID NO: 99, SEQ ID NO: 106, and SEQ ID NO: 145. It is contemplated that a bacterium may comprise one or more nucleic acids comprising the nucleotide sequences of SEQ ID NO: 139, SEQ ID NO: 154, SEQ ID NO: 131, SEQ ID NO: 98, SEQ ID NO: 115, SEQ ID NO: 106, and SEQ ID NO: 149, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 139, SEQ ID NO: 154, SEQ ID NO: 131, SEQ ID NO: 98, SEQ ID NO: 115, SEQ ID NO: 106, and SEQ ID NO: 149. It is contemplated that a bacterium may comprise one or more nucleic acids comprising the nucleotide sequences of SEQ ID NO: 137, SEQ ID NO: 113, SEQ ID NO: 148, SEQ ID NO: 129, and SEQ ID NO: 105, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 137, SEQ ID NO: 113, SEQ ID NO: 148, SEQ ID NO: 129, and SEQ ID NO: 105 It is contemplated that a bacterium may comprise one or more nucleic acids comprising the nucleotide sequences of SEQ ID NO: 145, SEQ ID NO: 137, SEQ ID NO: 153, SEQ ID NO: 129, and SEQ ID NO: 105, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 145, SEQ ID NO: 137, SEQ ID NO: 153, SEQ ID NO: 129, and SEQ ID NO: 105. It is contemplated that a bacterium may comprise one or more nucleic acids comprising the nucleotide sequences of SEQ ID NO: 155, SEQ ID NO: 137, SEQ ID NO: 128, SEQ ID NO: 144, SEQ ID NO: 115, SEQ ID NO: 98, and SEQ ID NO: 105, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 155, SEQ ID NO: 137, SEQ ID NO: 128, SEQ ID NO: 144, SEQ ID NO: 115, SEQ ID NO: 98, and SEQ ID NO: 105. It is contemplated that a bacterium may comprise one or more nucleic acids comprising the nucleotide sequences of SEQ ID NO: 145, SEQ ID NO: 137, SEQ ID NO: 153, SEQ ID NO: 129, SEQ ID NO: 105, SEQ ID NO: 113, and SEQ ID NO: 96, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 145, SEQ ID NO: 137, SEQ ID NO: 153, SEQ ID NO: 129, SEQ ID NO: 105, SEQ ID NO: 113, and SEQ ID NO: 96. It is contemplated that a bacterium may comprise one or more nucleic acids comprising the nucleotide sequences of SEQ ID NO: 145, SEQ ID NO: 137, SEQ ID NO: 153, SEQ ID NO: 129, SEQ ID NO: 105, and SEQ ID NO: 96, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 145, SEQ ID NO: 137, SEQ ID NO: 153, SEQ ID NO: 129, SEQ ID NO: 105, and SEQ ID NO: 96. It is contemplated that a bacterium may comprise one or more nucleic acids comprising the nucleotide sequences of SEQ ID NO: 139, SEQ ID NO: 129, SEQ ID NO: 155, SEQ ID NO: 112, SEQ ID NO: 99, SEQ ID NO: 106, and SEQ ID NO: 145, or nucleotide sequences having at least 80%, 85%, 86%, 87%, 88%, 89%, 90%, 91%, 92%, 93%, 94%, 95%, 96%, 97%, 98%, or 99% identity to SEQ ID NO: 139, SEQ ID NO: 129, SEQ ID NO: 155, SEQ ID NO: 112, SEQ ID NO: 99, SEQ ID NO: 106, and SEQ ID NO: 145.

It is contemplated that a bacterium may comprise one or more nucleic acids comprising the nucleotide sequence of any one of SEQ ID NOs: 82-95, or a nucleotide sequence having at least 80%, 85%, 86%, 87%, 88%, 89%, 90%, 91%, 92%, 93%, 94%, 95%, 96%, 97%, 98%, or 99% identity to the nucleotide sequence of any one of SEQ ID NOs: 82-95.

II. Pharmaceutical Compositions/Units

A bacterium disclosed herein may be combined with pharmaceutically acceptable excipients to form a pharmaceutical composition, which can be administered to a patient by any means known in the art. As used herein, the term "pharmaceutically acceptable excipient" is understood to mean one or more of a buffer, carrier, or excipient suitable for administration to a subject, for example, a human subject, without excessive toxicity, irritation, allergic response, or other problem or complication, commensurate with a reasonable benefit/risk ratio. The excipient(s) should be "acceptable" in the sense of being compatible with the other ingredients of the formulations and not deleterious to the recipient.

Pharmaceutically acceptable excipients include buffers, solvents, dispersion media, coatings, isotonic and absorption delaying agents, and the like, that are compatible with pharmaceutical administration. Pharmaceutically acceptable excipients also include fillers, binders, disintegrants, glidants, lubricants, and any combination(s) thereof. For further examples of excipients, carriers, stabilizers and adjuvants, see, e.g., Handbook of Pharmaceutical Excipients, 8$^{th}$ Ed., Edited by P. J. Sheskey, W. G. Cook, and C. G. Cable, Pharmaceutical Press, London, UK [2017]. The use of such media and agents for pharmaceutically active substances is known in the art.

Contemplated bacteria may be used in disclosed compositions in any form, e.g., a stable form, as known to those skilled in the art, including in a lyophilized state (with optionally one or more appropriate cryoprotectants), frozen (e.g., in a standard or super-cooled freezer), spray dried, and/or freeze dried. A "stable" formulation or composition is one in which the biologically active material therein essentially retains its physical stability, chemical stability, and/or biological activity upon storage. Stability can be measured at a selected temperature and humidity conditions for a selected time period. Trend analysis can be used to estimate an expected shelf life before a material has actually been in storage for that time period. For live bacteria, for example, stability may be defined as the time it takes to lose 1 log of cfu/g dry formulation under predefined conditions of temperature, humidity and time period.

A bacterium disclosed herein may be combined with one or more cryoprotectants. Exemplary cryoprotectants include fructoligosaccharides (e.g., raftilose®), trehalose, maltodextrin, sodium alginate, proline, glutamic acid, glycine (e.g., glycine betaine), mono-, di-, or polysaccharides (such as glucose, sucrose, maltose, lactose), polyols (such as mannitol, sorbitol, or glycerol), dextran, DMSO, methylcellulose, propylene glycol, polyvinylpyrrolidone, non-ionic surfactants such as Tween 80, and/or any combinations thereof.

A pharmaceutical composition should be formulated to be compatible with its intended route of administration. Contemplated bacterial compositions disclosed herein can be prepared by any suitable method and can be formulated into a variety of forms and administered by a number of different means. Contemplated compositions can be administered orally, rectally, or enterally, in formulations containing conventionally acceptable carriers, adjuvants, and vehicles as desired. As used herein, "rectal administration" is understood to include administration by enema, suppository, or colonoscopy. A disclosed pharmaceutical composition may, e.g., be suitable for bolus administration or bolus release. In an exemplary embodiment, a disclosed bacterial composition is administered orally.

Solid dosage forms for oral administration include capsules, tablets, caplets, pills, troches, lozenges, powders, and granules. A capsule typically comprises a core material comprising a bacterial composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit®"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as a taste-masking agent.

Tablets, pills, and the like can be compressed, multiply compressed, multiply layered, and/or coated. A contemplated coating can be single or multiple. In one embodiment, a contemplated coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, porphyrans, agar, alginates, chitosans, or gellan gum. In some embodiments a contemplated coating material comprises a protein. In some embodiments a contemplated coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments a contemplated coating material comprises at least one edible wax. A contemplated edible wax can be derived from animals, insects, or plants. Non-limiting examples include beeswax, lanolin, bayberry wax, carnauba wax, and rice bran wax. Tablets and pills can additionally be prepared with enteric or reverse-enteric coatings.

Alternatively, powders or granules embodying a bacterial composition disclosed herein can be incorporated into a food product. In some embodiments a contemplated food product is a drink for oral administration. Non-limiting examples of a suitable drink include water, fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, emulsions, suspensions and solutions and/or suspensions reconstituted from non-effervescent granules, containing at least one of suitable solvents, preservatives, emulsifying agents, suspending agents, diluents, sweeteners, coloring agents, and flavoring agents.

Pharmaceutical compositions containing a bacterium disclosed herein can be presented in a unit dosage form, i.e., a pharmaceutical unit. A composition, e.g., a pharmaceutical unit provided herein, may include any appropriate amount of bacterium, measured either by total mass or by colony forming units of the bacteria.

For example, a disclosed pharmaceutical composition or unit may include from about $10^3$ cfus to about $10^{12}$ cfus, about $10^6$ cfus to about $10^{12}$ cfus, about $10^7$ cfus to about $10^{12}$ cfus, about $10^8$ cfus to about $10^{12}$ cfus, about $10^9$ cfus to about $10^{12}$ cfus, about $10^{10}$ cfus to about $10^{12}$ cfus, about $10^{11}$ cfus to about $10^{12}$ cfus, about $10^3$ cfus to about $10^{11}$ cfus, about $10^6$ cfus to about $10^{11}$ cfus, about $10^7$ cfus to about $10^{11}$ cfus, about $10^8$ cfus to about $10^{11}$ cfus, about $10^9$ cfus to about $10^{11}$ cfus, about $10^{10}$ cfus to about $10^{11}$ cfus, about $10^3$ cfus to about $10^{10}$ cfus, about $10^6$ cfus to about $10^{10}$ cfus, about $10^7$ cfus to about $10^{10}$ cfus, about $10^8$ cfus to about $10^{10}$ cfus, about $10^9$ cfus to about $10^{10}$ cfus, about $10^3$ cfus to about $10^9$ cfus, about $10^6$ cfus to about $10^9$ cfus, about $10^7$ cfus to about $10^9$ cfus, about $10^8$ cfus to about $10^9$ cfus, about $10^3$ cfus to about $10^8$ cfus, about $10^6$ cfus to about $10^8$ cfus, about $10^7$ cfus to about $10^8$ cfus, about $10^3$ cfus to about $10^7$ cfus, about $10^6$ cfus to about $10^7$ cfus, or about $10^3$ cfus to about $10^6$ cfus of each bacterial strain, or may include about $10^3$ cfus, about $10^6$ cfus, about $10^7$ cfus, about $10^8$ cfus, about $10^9$ cfus, about $10^{10}$ cfus, about $10^{11}$ cfus, or about $10^{12}$ cfus of bacteria.

III. Therapeutic Uses

Compositions and methods disclosed herein can be used to treat various diseases or disorders associated with an elevated amount of oxalate in a subject. As used herein, "elevated amount of oxalate in a subject" may refer to an elevated amount of oxalate in a body fluid (e.g., blood, plasma, serum, or urine), tissue and/or cell in a subject, relative to a subject without the disease or disorder. The disclosure provides a method of treating a disease or disorder associated with an elevated amount of oxalate in a subject. A contemplated method comprises administering to the subject an effective amount of a bacterium or a pharmaceutical composition disclosed herein, either alone or in a combination with another therapeutic agent, to treat the disease or disorder associated with an elevated amount of oxalate in the subject.

An example of a disease or disorder associated with an elevated amount of oxalate is hyperoxaluria, e.g., primary, enteric, dietary, or idiopathic hyperoxaluria. Hyperoxaluria, or increased urinary oxalate levels, can be characterized in humans by urinary oxalate excretion of greater than 40 mg (approximately 440 µmol) or 30 mg per day. Exemplary clinical cutoff levels are 43 mg/day (approximately 475 μmol) for men and 32 mg/day (approximately 350 μmol) for women. Hyperoxaluria can also be defined as urinary oxalate excretion greater than 30 mg per day per gram of urinary creatinine. Persons with mild hyperoxaluria may excrete at least 30-60 (342-684 μmol) or 40-60 (456-684 μmol) mg of oxalate per day. Persons with enteric hyperoxaluria may excrete at least 80 mg of urinary oxalate per day (912 μmol), and persons with primary hyperoxaluria may excrete at least 200 mg per day (2280 μmol).

Elevated urinary oxalate has been linked to a number of health problems in the kidney, e.g., kidney stones (e.g., recurrent calcium oxalate kidney stones), nephrocalcinosis, nephrolithiasis, kidney damage, or end-stage renal disease. Calcium oxalate may also be deposited in the urinary tract, colon, small intestine, eyes, blood vessels, joints, bones, muscles, heart and other major organs, causing damage to the same. Accordingly, additional exemplary diseases or disorders associated with an elevated amount of oxalate include kidney disorders (e.g., kidney stones, nephrocalcinosis, polycystic kidney disease, nephrolithiasis, or renal failure (including progressive, chronic, or end-stage renal failure)), urinary tract disorders (e.g., idiopathic urinary stone disease, or urolithiasis), gastrointestinal disorders (e.g., inflammatory bowel disease, Crohn's disease, or ulcerative colitis), pancreatic disorders (e.g., exocrine pancreatic insufficiency), joint disorders, eye disorders, liver disorders, ethylene glycol poisoning, cystic fibrosis, steatorrhoea, ileal disease, vulvodynia, cardiac conductance disorders, osteoporosis, and complications from gastric bypass or other types of gastrointestinal surgery.

As used herein, "treat", "treating" and "treatment" mean the treatment of a disease in a subject, e.g., in a human. This includes: (a) inhibiting the disease, i.e., arresting its development; and (b) relieving the disease, i.e., causing regression of the disease state. As used herein, the terms "subject" and "patient" refer to an organism to be treated by the methods and compositions described herein. Such organisms preferably include, but are not limited to, mammals, e.g., human, a companion animal (e.g., dog, cat, or rabbit), or a livestock animal (for example, cow, sheep, pig, goat, horse, donkey, and mule, buffalo, oxen, or camel)).

It will be appreciated that the exact dosage of a pharmaceutical composition, or bacterium is chosen by an individual physician in view of the patient to be treated, in general, dosage and administration are adjusted to provide an effective amount of the bacterial agent to the patient being treated. As used herein, the "effective amount" refers to the amount necessary to elicit a beneficial or desired biological response. An effective amount can be administered in one or more administrations, applications or dosages and is not intended to be limited to a particular formulation or administration route. As will be appreciated by those of ordinary skill in this art, the effective amount of a pharmaceutical unit, pharmaceutical composition, or bacterial strain may vary depending on such factors as the desired biological endpoint, the drug to be delivered, the target tissue, the route of administration, etc. Additional factors which may be taken into account include the severity of the disease state; age, weight and gender of the patient being treated; diet, time and frequency of administration; drug combinations; reaction sensitivities; and tolerance/response to therapy.

Contemplated methods may further comprise administrating a privileged nutrient to the subject to support colonization of the bacterium. Exemplary privileged nutrients include marine polysaccharides, e.g., a porphyran. For example, a disclosed privileged nutrient may be administered to the subject prior to, at the same time as, or after a disclosed bacterium.

Methods and compositions described herein may reduce oxalate levels in a subject, e.g., in a body fluid (e.g., blood, plasma, serum, or urine), tissue and/or cell in a subject, by at least about 10%, about 20%, about 30%, about 40%, about 50%, about 60%, about 70%, about 80%, about 90%, about 95%, or more, relative to oxalate levels in an untreated or control subject.

Contemplated methods may comprise administration of a disclosed bacterium or pharmaceutical composition to a subject every 12 hours, 24 hours, day, 2 days, 3 days, 4 days, 5 days, 6 days, 7 days, week, 2 weeks, 3 weeks, 4 weeks, month, 2 months, 3 months, 4 months, 5 months, or 6 months. In certain embodiments, the time between consecutive administrations of a disclosed bacterium or pharmaceutical composition to a subject is greater than 12 hours, 24 hours, 36 hours, 48 hours, 2 days, 3 days, 4 days, 5 days, 6 days, 7 days, 1 week, 2 weeks, 3 weeks, or 4 weeks.

In certain embodiments, a disclosed bacterium and a disclosed privileged nutrient, e.g., a marine polysaccharide, e.g., a porphyran are administered to a subject with the same frequency. For example, the bacterium and the privileged nutrient may both be administered to the subject every 12 hours, 24 hours, day, 2 days, 3 days, 4 days, 5 days, 6 days, 7 days, week, 2 weeks, 3 weeks, 4 weeks, month, 2 months, 3 months, 4 months, 5 months, or 6 months. In certain embodiments, a disclosed bacterium and a disclosed privileged nutrient, e.g., a marine polysaccharide, e.g., a porphyran, are administered to a subject with a different frequency. For example, the bacterium may be administered to the subject every 12 hours, 24 hours, day, 2 days, 3 days, 4 days, 5 days, 6 days, 7 days, week, 2 weeks, 3 weeks, 4 weeks, month, 2 months, 3 months, 4 months, 5 months, or 6 months, and the privileged nutrient may be administered to the subject every 12 hours, 24 hours, day, 2 days, 3 days, 4 days, 5 days, 6 days, 7 days, week, 2 weeks, 3 weeks, 4 weeks, month, 2 months, 3 months, 4 months, 5 months, or 6 months. For example, in certain embodiments, the bacterium may be administered to the subject every week, 2 weeks, 3 weeks, 4 weeks, month, 2 months, 3 months, 4 months, 5 months, or 6 months, and the privileged nutrient may be administered to the subject every 12 hours, 24 hours, day, 2 days, 3 days, 4 days, 5 days, 6 days, or 7 days.

Methods and compositions described herein can be used alone or in combination with other therapeutic agents and/or modalities. The term administered "in combination," as used herein, is understood to mean that two (or more) different treatments are delivered to the subject during the course of the subject's affliction with the disorder, such that the effects of the treatments on the patient overlap at a point in time. In certain embodiments, the delivery of one treatment is still occurring when the delivery of the second begins, so that there is overlap in terms of administration. This is sometimes referred to herein as "simultaneous" or "concurrent delivery." In other embodiments, the delivery of one treatment ends before the delivery of the other treatment begins. In certain embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In certain embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered. In certain embodiments, a side effect of a first and/or second treatment is reduced because of combined administration.

In certain embodiments, a method or composition described herein is administered in combination with one or more additional therapies. In certain embodiments, a contemplated additional therapy may include: high fluid intake; a low-salt, low-oxalate, and/or a high-calcium diet; citrate, calcium, orthophosphate, and/or pyridoxine/vitamin B6 supplementation; the enzyme oxalate decarboxylase; and/or a peptide that stimulates the secretion of oxalate from the colon.

Throughout the description, where compositions are described as having, including, or comprising specific components, or where processes and methods are described as having, including, or comprising specific steps, it is contemplated that, additionally, there are compositions of the present disclosure that consist essentially of, or consist of, the recited components, and that there are processes and methods according to the present disclosure that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present disclosure, whether explicit or implicit herein. For example, where reference is made to a particular compound, that compound can be used in various embodiments of compositions of the present disclosure and/or in methods of the present disclosure, unless otherwise understood from the context. In other words, within this application, embodiments have been described and depicted in a way that enables a clear and concise application to be written and drawn, but it is intended and will be appreciated that embodiments may be variously combined or separated without parting from the present teachings and disclosure. For example, it will be appreciated that all features described and depicted herein can be applicable to all aspects of the disclosure described and depicted herein.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present disclosure also includes the specific quantitative value itself, unless specifically stated otherwise. As used herein, the term "about" refers to a ±10% variation from the nominal value unless otherwise indicated or inferred.

It should be understood that the order of steps or order for performing certain actions is immaterial so long as the present disclosure remains operable. Moreover, two or more steps or actions may be conducted simultaneously.

The use of any and all examples, or exemplary language herein, for example, "such as" or "including," is intended merely to illustrate better the present disclosure and does not pose a limitation on the scope of the disclosure unless claimed. No language in the specification should be construed as indicating any non-claimed element as essential to the practice of the present disclosure.

EXAMPLES

The following Examples are merely illustrative and are not intended to limit the scope or content of the disclosure in any way.

Example 1—Construction of Oxalate-Degrading Bacteroides

Adding oxalate-degradation capabilities to a member of the oxalate-naïve genus *Bacteroides* can be accomplished by addition of transgenes from other organisms (e.g., SEQ ID NOs: 1-31). For example, a construct including expression cassettes for the expression of OxlT, OXS, and OXC can be used to achieve oxalate degradation in *Bacteroides*. Exemplary OxlT coding sequences are depicted in SEQ ID NOs: 17-21, exemplary OXS coding sequences are depicted in SEQ ID NOs: 14-16, and exemplary OXC coding sequences are depicted in SEQ ID NOs: 22-26. Contemplated constructs may further include expression cassettes for the expression of FCOCT, ACOCT, or SCOCT. Exemplary FCOCT coding sequences are depicted in SEQ ID NOs: 4-8, exemplary ACOCT coding sequences are depicted in SEQ ID NOs: 1-2 and exemplary SCOCT coding sequences are depicted in SEQ ID NOs: 28-31. Expression of additional copies of OXS and/or OXC may also improve oxalate degradation.

Figure 3:
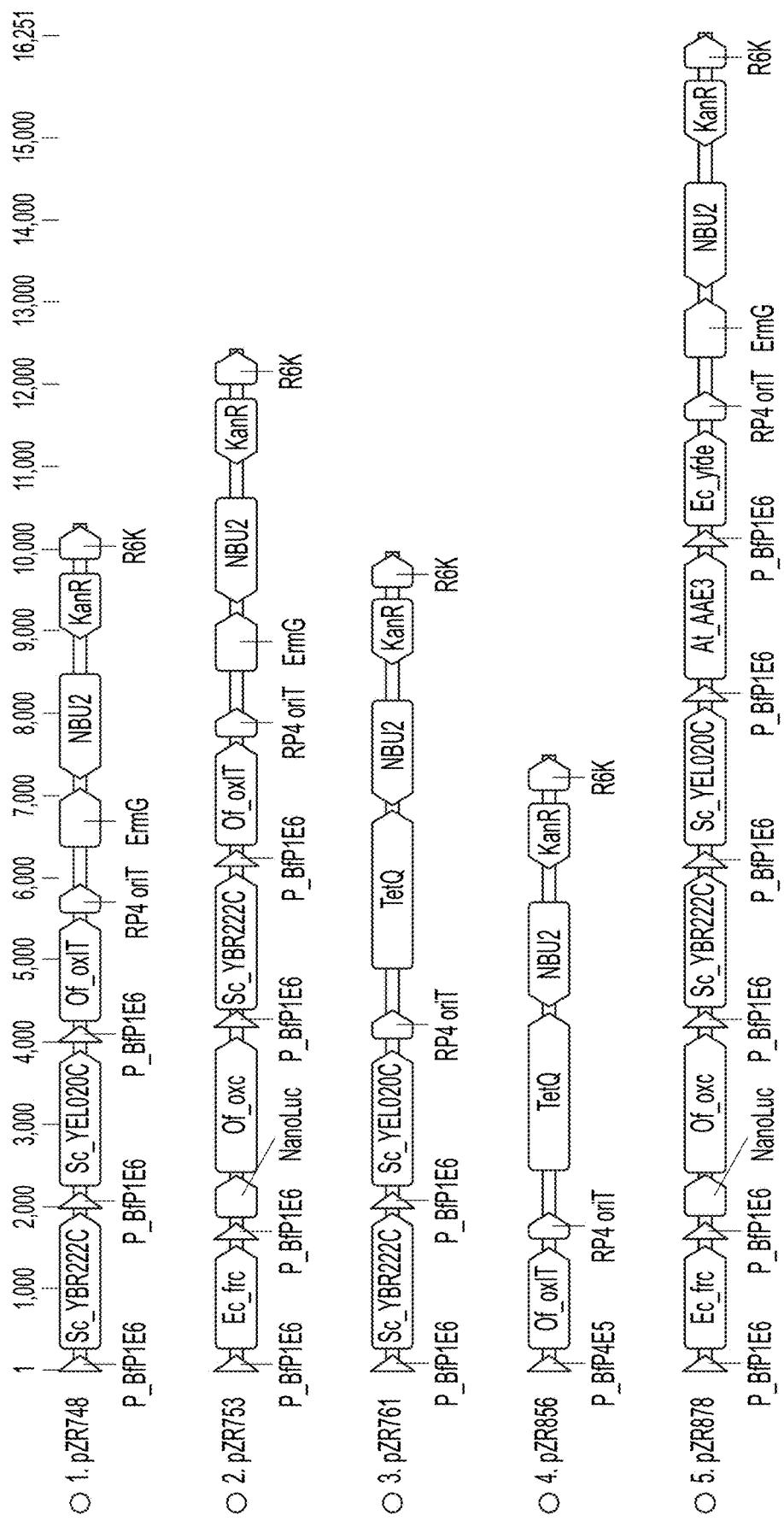
FIG. 3 depicts a schematic representation of five different plasmids (SEQ ID NOs: 63-67) which can be conjugated into *Bacteroides* to yield oxalate-degrading *Bacteroides* strains.

FIG. 3 shows different plasmids (SEQ ID NOs: 63-67) which can be used individually or in combination to generate *Bacteroides* with oxalate degradation capabilities. pZR748 (SEQ ID NO: 63) includes coding sequences for a *S. cerevisiae* OXS, a *S. cerevisiae* OXC, and an *O. formigenes* OxlT. pZR753 (SEQ ID NO: 64) includes coding sequences for an *E. coli* FCOCT, an *O. formigenes* OXC, a *S. cerevisiae* OXS, and an *O. formigenes* OxlT. pZR761 (SEQ ID NO: 65) includes coding sequences for a *S. cerevisiae* OXS and a *S. cerevisiae* OXC. pZR856 (SEQ ID NO: 66) includes a coding sequence for an *O. formigenes* OxlT. pZR878 (SEQ ID NO: 67) includes coding sequences for an *E. coli* FCOCT, an *O. formigenes* OXC, a *S. cerevisiae* OXS, a *S. cerevisiae* OXC, an *A. thaliana* OXS, and an *E. coli* ACOCT.

Each copy of an oxalate catabolism-related gene was operably linked to a copy of either a phage derived promoter, P_BfP1E6 (SEQ ID NO: 68), or a weakened version thereof, P_BfP4E5 (SEQ ID NO: 69). Other promoters, including P_BfP2E5 (SEQ ID NO: 80) and others those matching a phage-derived consensus sequence (SEQ ID NO: 70), can also be used. To optimize the translation rate of the enzymes, enzymes were fused to either a leader peptide coupled to a high-strength ribosome binding site (RBS) (SEQ ID NO:

78), or a NanoLuc luciferase reporter enzyme coupled to a high-strength RBS (SEQ ID NO: 79). Other ribosome binding sites and translational fusions can also be used. The plasmids carry an NBU2 integrase gene, which catalyzes genomic integration of the plasmid at the 3' end of a serine-tRNA gene in the *Bacteroides* genome.

Once constructed, the plasmids were transformed into *Escherichia coli* S17-1 donor cells bearing the RK2 conjugative plasmid. The RK2 conjugative machinery allows for conjugative transfer of plasmids bearing an RP4 transfer origin to a variety of species, including *Bacteroides*. These cells were mixed with *Bacteroides* recipient cells and plated onto nonselective BHI agar plates for an overnight incubation at 37° C. Afterwards, plates were scraped and the mixture of *E. coli* S17-1 and *Bacteroides* were transferred to selective media with gentamycin to suppress the *E. coli* and cultured under anaerobic conditions. Multiple selective markers (such as tetracycline, erythromycin, or chloramphenicol) can be used to deliver multiple constructs into a single *Bacteroides* strain.

Example 2—In Vitro Testing of Oxalate Degradation in Liquid Culture

Figure 4:
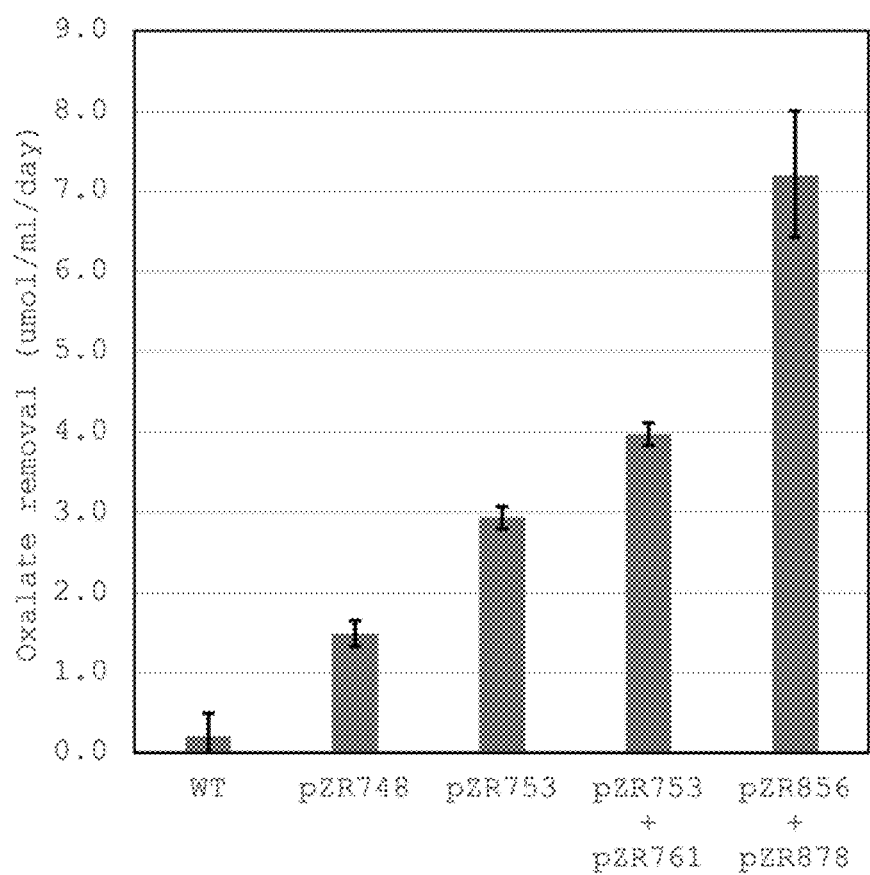
FIG. 4 is a bar graph depicting the amount of oxalate consumed by *Bacteroides vulgatus* ATCC 8482 with either no transgenes (wildtype), or with genomic integration of the following plasmids: pZR748 (SEQ ID NO: 63), pZR753 (SEQ ID NO: 64), pZR753+pZR761 (SEQ ID NOs: 64, 65), or pZR856+pZR878 (SEQ ID NOs: 66, 67). Overnight cultures of each *Bacteroides* strain were diluted 1:10 into fresh BHIS liquid media supplemented with 10 or 30 mM oxalate, and oxalate consumption rates were monitored over 48 hours.

Engineered *Bacteroides*, constructed as described in Example 1, were assayed for oxalate degradation capacity in an in vitro assay. *Bacteroides* cells were diluted from an overnight culture 1:10 into BHIS liquid media with 10 or 30 mM added sodium oxalate. The cultures were incubated anaerobically at 37° C. overnight. After 48 hours, the cultures were centrifuged to separate out the cells, and the supernatant was taken for analysis. Samples were analyzed using a 595 nm oxalate oxidase kit (Sigma-Aldrich, Catalog # MAK315-1KT) and compared to a standard curve in order to calculate oxalate consumption rates. The resulting data from testing plasmids pZR748 (SEQ ID NO: 63), pZR753 (SEQ ID NO: 64), pZR753+pZR761 (SEQ ID NOs: 64, 65), and pZR856+pZR878 (SEQ ID NOs: 66, 67) in a background of *Bacteroides vulgatus* ATCC 8482 is shown in FIG. 4. As depicted, oxalate consumption of each engineered strain was increased relative to wildtype, which showed no capacity for oxalate consumption.

Example 3—Engineering of Privileged Nutrient Consumption Into Bacteroides

Figure 5:
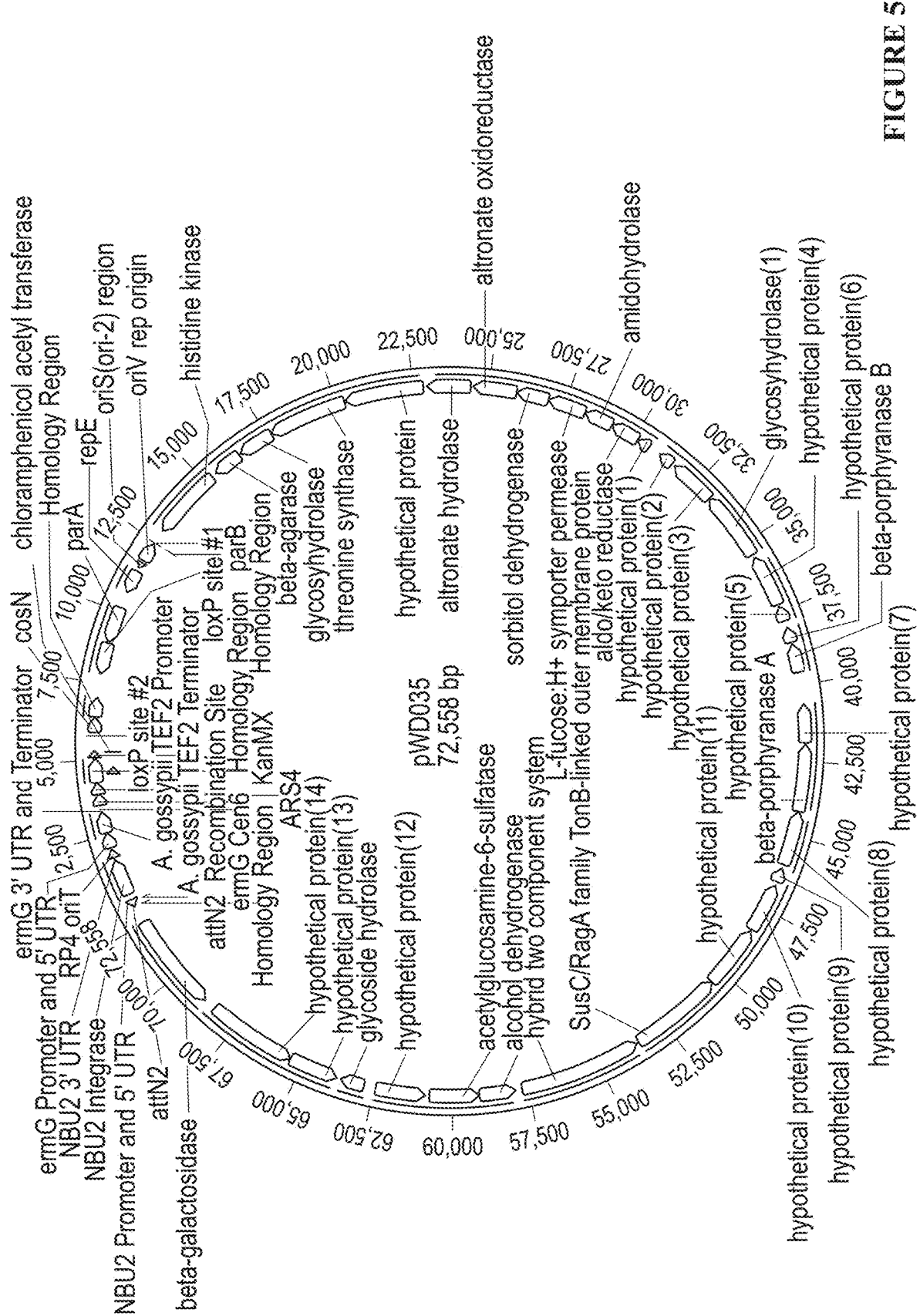
FIG. 5 depicts a schematic representation of plasmid pWD035 (SEQ ID NO: 73), a bacterial artificial chromosome bearing a conjugative transfer origin and a porphyran polysaccharide utilization locus (PUL).

A polysaccharide utilization locus (PUL) is a mobile genetic element that confers the ability to consume new carbohydrates upon a bacterium. A porphyran consumption PUL was identified in the porphyran-consuming *Bacteroides* strain isolate NB001 (SEQ ID NO: 72) and a 60 kb region of the PUL was cloned into a bacterial artificial chromosome (BAC) to make pWD035 (SEQ ID NO: 73). The content of pWD035 is shown in FIG. 5.

Figure 6:
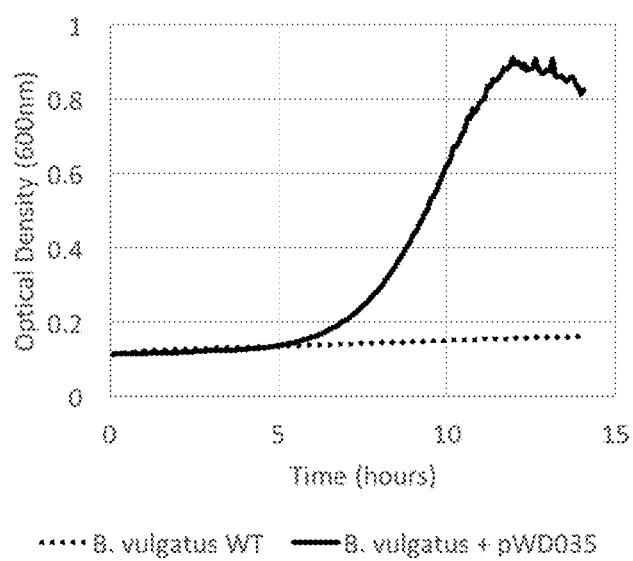
FIG. 6 depicts an in vitro growth assay of *Bacteroides vulgatus* cells that received a functional porphyran PUL (pWD035, SEQ ID NO: 73) compared to wildtype *B. vulgatus* cells. Saturated cultures were diluted 50× into minimal media supplemented with 0.2% porphyran and grown anaerobically for 14 hours at 37° C. Optical density of the cultures was monitored throughout. Only the cells that contained the porphyran PUL were capable of growth on porphyran.

Plasmid pWD035 was conjugated into *Bacteroides vulgatus* ATCC 8482 using *E. coli* S17-1 to generate strain NB075. This strain was tested for its ability to consume the marine polysaccharide porphyran. Cells were diluted 1:50 from an overnight culture into Salyer's minimal media containing 0.2% porphyran extract from *Porphyra yezoensis* nori. Over 14 hours of anaerobic incubation at 37° C., the OD600, representing cell growth, was measured using a plate reader. Results, shown in FIG. 6, demonstrated that only the cells that received the porphyran PUL gained the ability to consume porphyran for growth.

Figure 7:
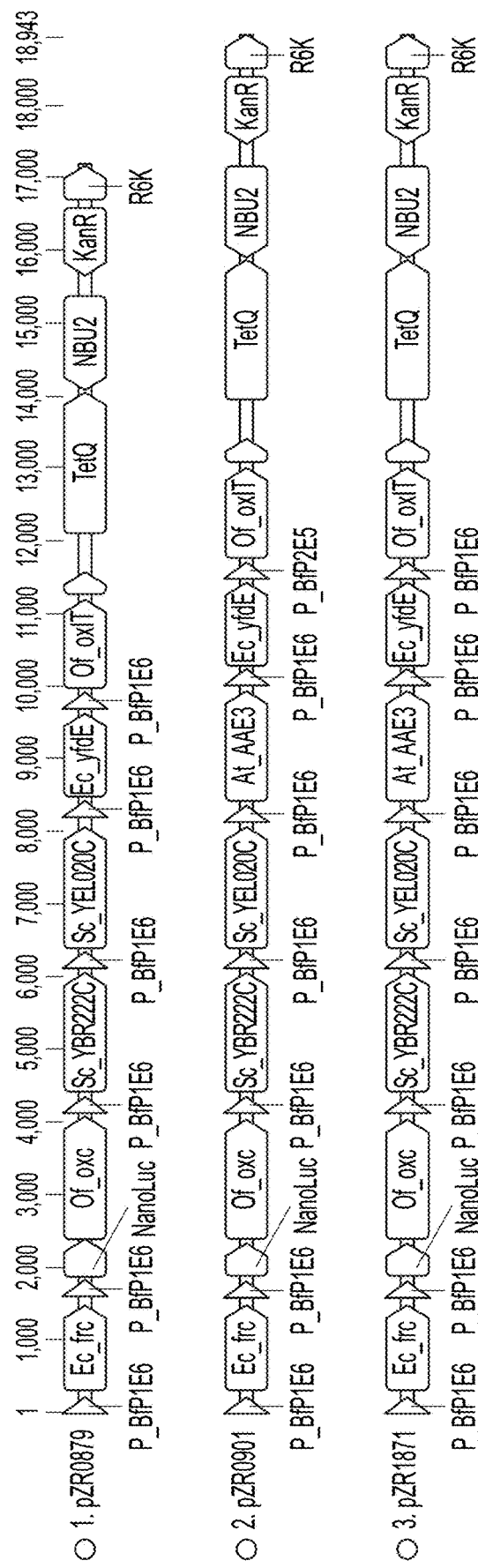
FIG. 7 depicts three different plasmids (SEQ ID NOs: 75-77) harboring oxalate-consumption genes. Each plasmid was conjugated into the porphyran-utilizing strain NB075 to yield strains that could consume both a privileged nutrient, porphyran, and a gut-derived toxin, oxalate.

Example 4—Engineering Strains That Can Consume Both Oxalate and a Privileged Nutrient FIG. 7 shows plasmids (SEQ ID NO: 75-77) which can be used individually or in combination to generate *Bacteroides* with high-efficiency oxalate degradation capabilities. pZR0879 (SEQ ID NO: 75) includes coding sequences for an *E. coli* FCOCT, an *O. formigenes* OXC, a *S. cerevisiae* OXS, a *S. cerevisiae* OXC, an *E. coli* ACOCT, and an *O. formigenes* OxIT. pZR0901 (SEQ ID NO: 76) includes coding sequences for an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT. pZR1871 (SEQ ID NO: 77) includes coding sequences for an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT.

Strains that are capable of simultaneously consuming porphyran and oxalate were generated by conjugation and selective plating of plasmids pZR0879, pZR0901, and pZR1871, into strain NB075 (described in Example 3). An empty vector (pZR1622, SEQ ID 74) was also included in order to construct a non-oxalate consuming control strain. For two of the conjugations (pZR879 and pZR1871), in order to find strains with increased oxalate consumption rates, ~3,000 colonies were isolated from an individual selective plate. These clonal isolates were then subjected to a modified version of the oxalate consumption assay described in Example 1, which was run in high-throughput on a Labcyte Echo 525 acoustic liquid handling robot. Approximately 0.001% of clonal isolates proved to be outliers that demonstrated significantly faster oxalate consumption rates than the majority of isolates. Whole genome sequencing on an Illumina iSeq 100 was used to confirm that these strains harbored two copies of the plasmid of interest in their genome, presumably leading to increased expression of the oxalate pathway genes. Details of the generated strains, including the plasmid copy number, are depicted in TABLE 1.

TABLE 1

*Bacteroides* strains engineered to consume both porphyran and oxalate

| Strain Name | Parental Strain | Plasmid Name | SEQ ID | Copies Integrated | Porphyran Consumer | Oxalate Consumer |
|---|---|---|---|---|---|---|
| *B. vulgatus* 8482 | — | — | — | — | No | No |
| NB075 | *B. vulgatus* 8482 | pWD035 | 73 | 1 | Yes | No |
| NB124 | NB075 | pZR1622 | 74 | 1 | Yes | No |
| sWW152 | NB075 | pZR0901 | 76 | 1 | Yes | Yes |
| NB120 | NB075 | pZR1871 | 77 | 1 | Yes | Yes |

TABLE 1-continued

Bacteroides strains engineered to consume both porphyran and oxalate

| Strain Name | Parental Strain | Plasmid Name | SEQ ID | Copies Integrated | Porphyran Consumer | Oxalate Consumer |
|---|---|---|---|---|---|---|
| sWW554 | NB075 | pZR0879 | 75 | 2 | Yes | Yes |
| sWW626 | NB075 | pZR1871 | 77 | 2 | Yes | Yes |

Figure 8:
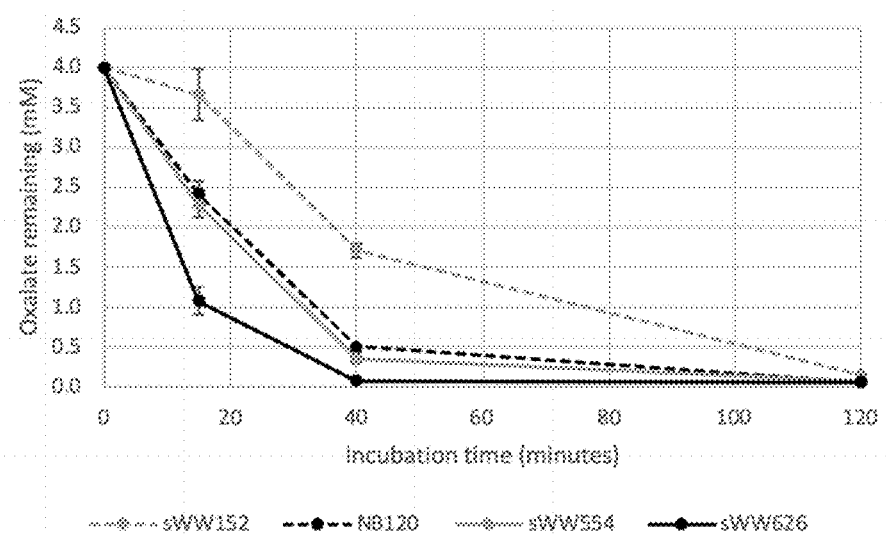
FIG. 8 is a line graph depicting the rate of oxalate consumption for the indicated engineered *Bacteroides* strains following addition of the strains at $10^{10}$ cfu/ml to fresh BHIS media containing 4 mM oxalate.

The four oxalate-consuming strains (sWW152, NB120, sWW554, and sWW626) were tested in an in vitro oxalate consumption assay to compare their respective oxalate consumption rates. Each strain was grown to saturation anaerobically in BHIS media at 37° C. The cultures were then pelleted and resuspended in one-tenth of the starting volume with fresh BHIS that had been supplemented with 4 mM oxalate. Dilution plating of the 10-fold concentrated cultures indicated they contained ~1×10$^{10}$ cfu/ml, which is the approximate abundance that these strains reach in the cecum when allowed to colonize the gut. The concentrated cultures were transferred back into an anaerobic chamber and allowed to incubate at 37° C. At regular intervals, culture aliquots were removed from the anaerobic chamber, transferred onto ice, pelleted, and the supernatant was frozen. The supernatant aliquots were then measured to determine the concentration of oxalate remaining. Results are depicted in FIG. 8. As expected, each strain reduced oxalate concentration in the supernatant, with sWW626, consuming 75% of the oxalate within 15 minutes.

Example 5—Ex Vivo Testing of Oxalate Consumption Rates in Rat Cecal Contents

Figure 9:
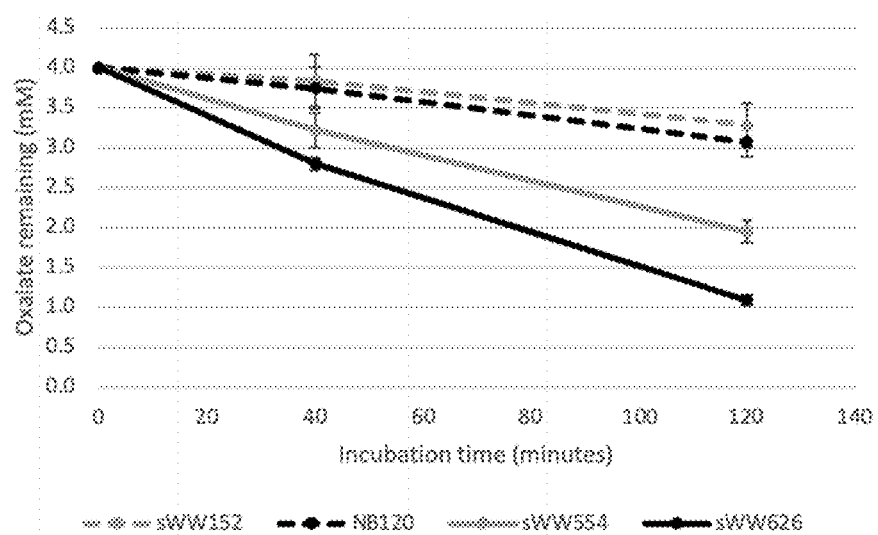
FIG. 9 is a line graph depicting the rate of oxalate consumption for the indicated engineered *Bacteroides* strains following addition of the strains at $10^{10}$ cfu/ml to cecal contents from Sprague-Dawley rats containing 4mM oxalate.

Candidate oxalate/porphyran-consuming strains described in Example 4 were next subjected to an ex-vivo oxalate consumption assay designed to simulate in vivo conditions as closely as possible. First, the cecums of multiple Sprague-Dawley rats fed a low oxalate diet were harvested, and the contents were extruded and diluted 3-fold into distilled water to aid in pipetting. Oxalate was added to a final concentration of 4 mM. Oxalate-consuming strains were then added to a final concentration of 1×10$^{10}$ cfu/ml to match their expected in vivo abundance in the cecum. Oxalate consumption over time was monitored as described above. Results are depicted in FIG. 9. Again, each strain consumed oxalate in the cecal contents, although the rate of oxalate consumption in cecal contents was ~10-fold slower than it had been in BHIS media.

Example 6—In Vivo Efficacy in a Rat Model of Secondary Hyperoxaluria

Figure 10:
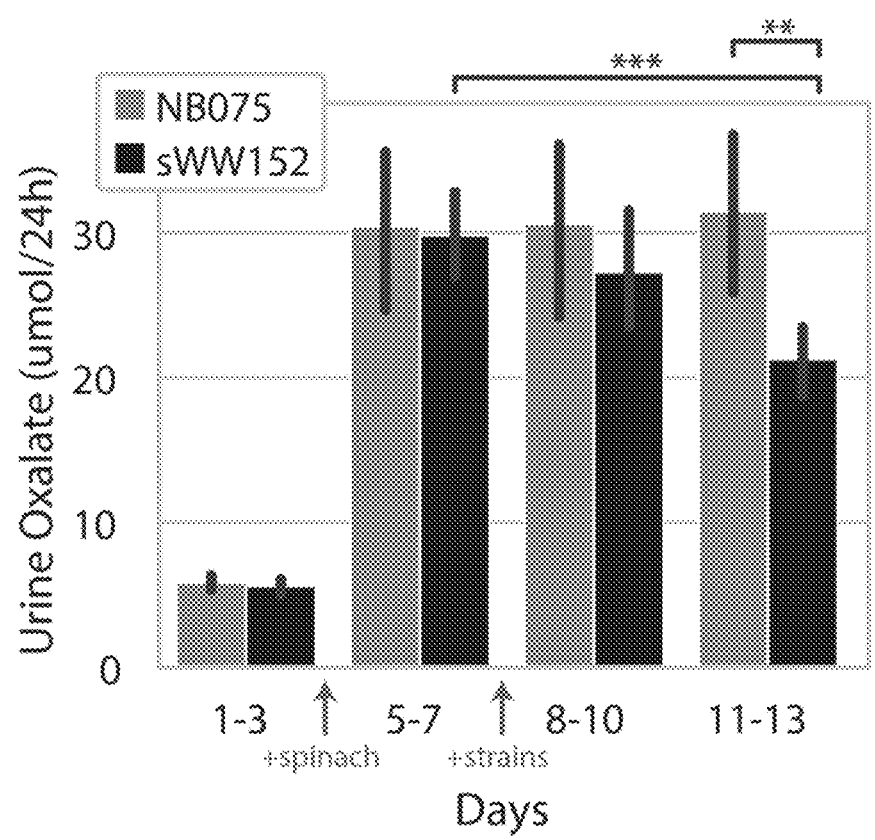
FIG. 10 is a bar graph depicting urine oxalate levels in a rat model of secondary hyperoxaluria following treatment with the indicated strain. Relative to a non-oxalate-consuming control strain (NB075), the oxalate-consuming strain sWW152 yields a 32% reduction in urine oxalate 4-6 days after strain administration (p=0.005). Error bars represent 95% confidence intervals.
Figure 11:
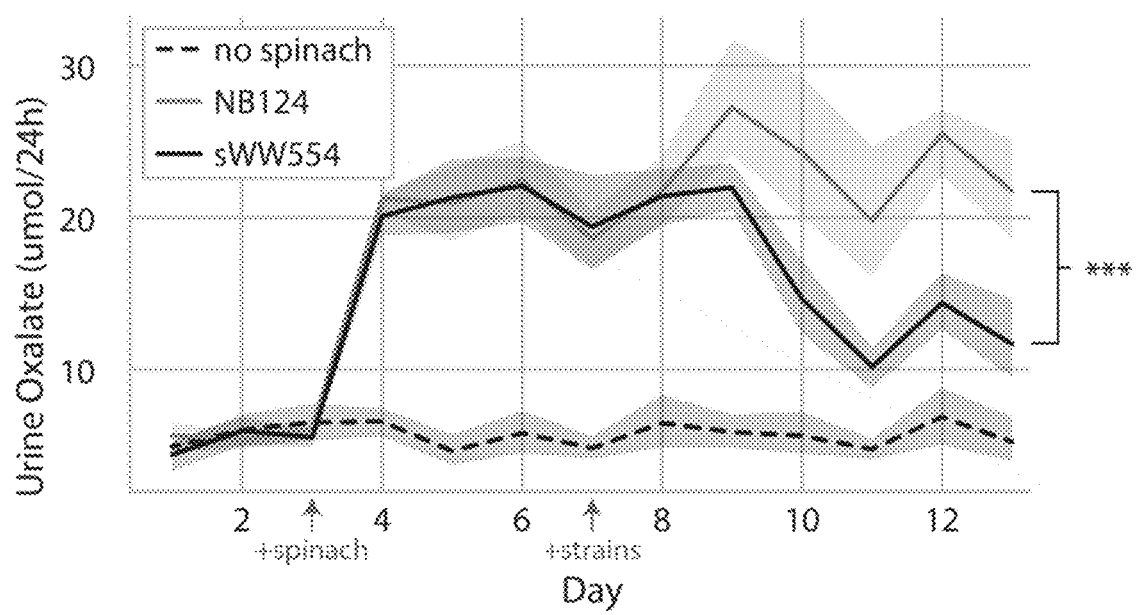
FIG. 11 is a line graph depicting urine oxalate levels in a rat model of secondary hyperoxaluria following treatment with the indicated strain. Relative to a non-oxalate-consuming control strain (NB124), the oxalate-consuming strain sWW554 yields a 46% reduction in urine oxalate 4-6 days after strain administration (p=0.0003). Shaded regions represent 95% confidence intervals.
Figure 12:
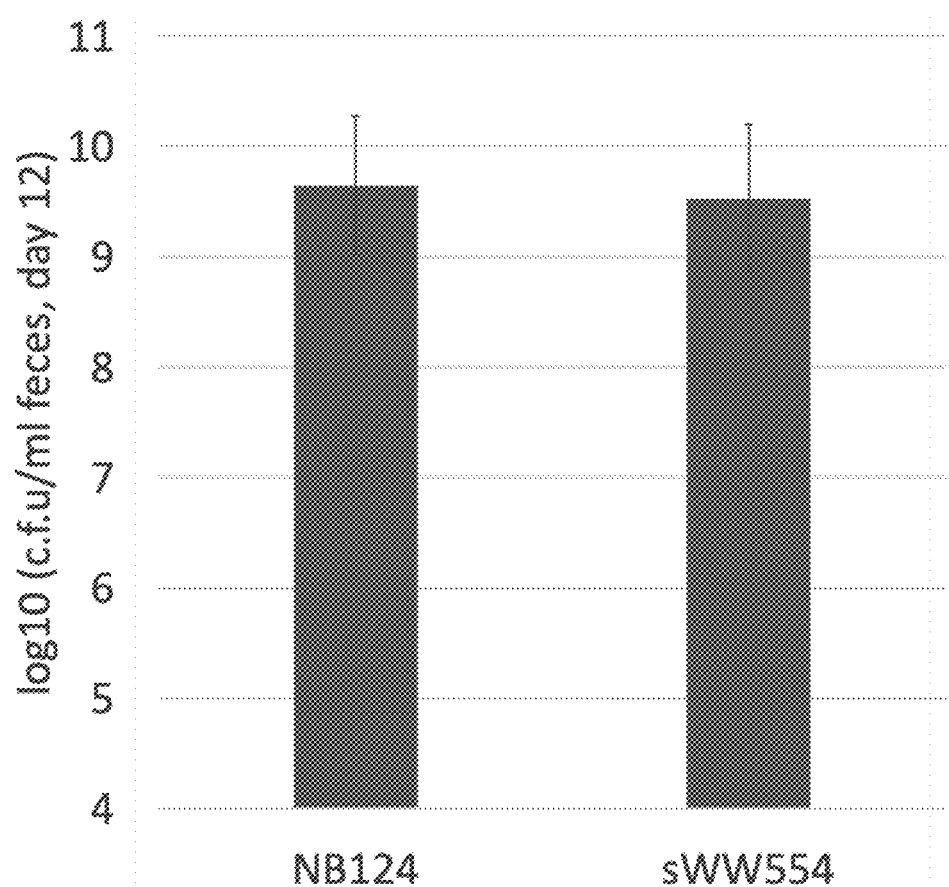
FIG. 12 is a bar graph depicting the fecal abundance of each strain from day 12 of the experiment summarized in FIG. 11.

To demonstrate that oxalate-consuming Bacteroides strains can be used to treat hyperoxaluria, candidate strains were subjected to in vivo testing in a rat model of secondary hyperoxaluria. Hyperoxaluria was induced via a low calcium diet that causes overabsorption of dietary oxalate. FIG. 10 and FIG. 11 depict the results of in vivo experiments designed to test the efficacy of candidate therapeutic strains sWW152 and sWW554, respectively. Male Sprague-Dawley rats weighing approximately two hundred grams were housed individually in metabolic cages (Tecniplast, 3700M022) and fed a low calcium (<0.01%), low oxalate base diet (Envigo, TD.160869). Twenty-four-hour urine was collected daily and analyzed for total oxalate throughout each experiment. Starting on day three and continuing for the remainder of the experiment, either 52 µmol oxalate per day (FIG. 10) or 30 µmol oxalate per day (FIG. 11) in the form of fresh spinach was added to the base diet, resulting in hyperoxaluria. Starting on either day two (FIG. 10) or day seven (FIG. 11) and continuing for the remainder of the experiment, 780 mg porphyran/day was also added to the base diet. On day seven, either a control strain unable to degrade oxalate (NB075 in FIG. 10 or NB124 in FIG. 11) or the therapeutic, oxalate degrading strain (sWW152 in FIG. 10 or sWW554 in FIG. 11) was administered by adding 10$^9$ cfu to the drinking water. Addition of sWW152 resulted in a 32% reduction in urine oxalate compared to the control strain (FIG. 10, p=0.005), while the addition of the improved strain sWW554 resulted in a 46% reduction in urine oxalate compared to the control strain (FIG. 11, p=0.0003). Both control and therapeutic strains colonized the rat gut at high abundance in the presence of porphyran, making up approximately 3*10$^9$ cfu/mL of feces within a few days (FIG. 12).These results demonstrate the ability of engineered oxalate degrading Bacteroides to lower urinary oxalate in a rodent model of secondary hyperoxaluria. Furthermore, given that strain sWW554 had a larger therapeutic impact than sWW152, increasing the strain's oxalate consumption rate appeared to translate to improved in vivo efficacy.

Example 7—In Vivo Efficacy in a Rat Model of Secondary Hyperoxaluria

Figure 13A:
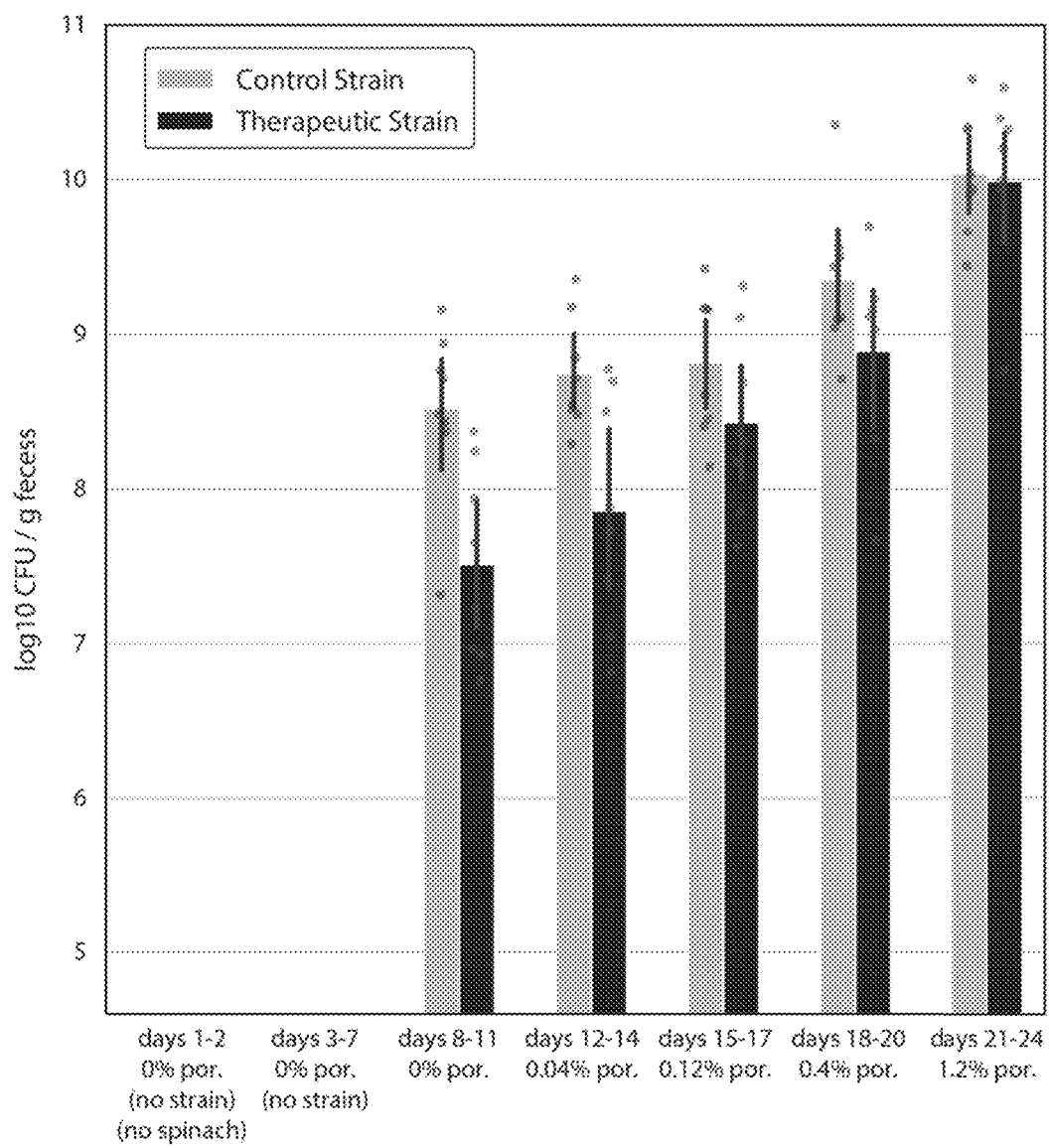
FIG. 13A is a bar graph depicting strain abundance (measured by colony forming units (CFU) per gram feces) in a rat model of secondary hyperoxaluria following treatment with the indicated strain and the indicated amount (% by weight) of porphyran administered in the drinking water.
Figure 13B:
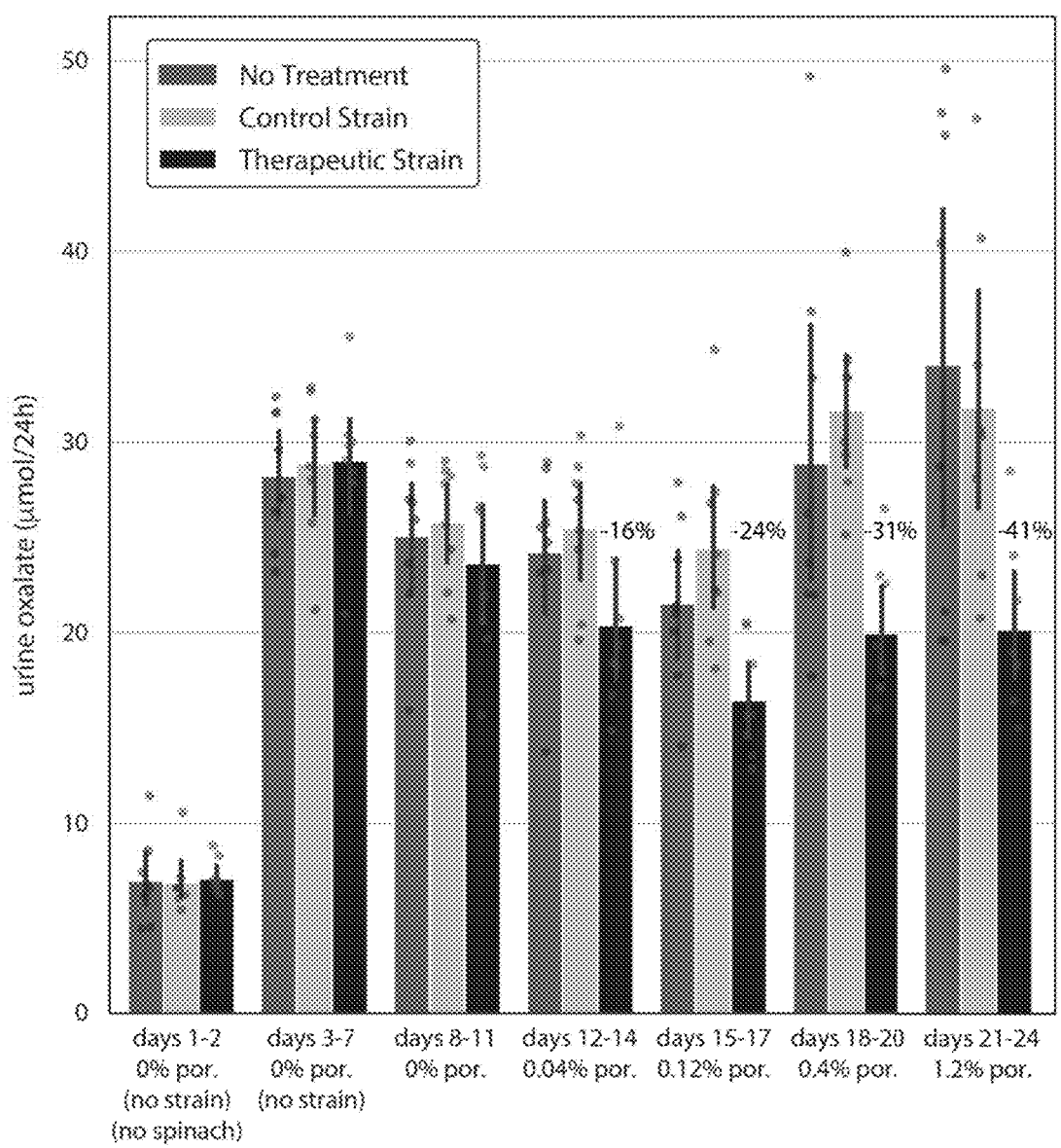
FIG. 13B is a bar graph depicting urine oxalate levels in a rat model of secondary hyperoxaluria following treatment with the indicated strain and the indicated amount (% by weight) of porphyran administered in the drinking water. Bars represent mean, points represent individual animals, and error bars represent 95% confidence intervals.

To demonstrate that oxalate-consuming Bacteroides strains can be used to treat hyperoxaluria, candidate strains were subjected to in vivo testing in a rat model of secondary hyperoxaluria.

sWW626 (as described in Example 4) was modified to contain an erythromycin resistance cassette to make strain sWW627. FIG. 13A and FIG. 13B depict the results of in vivo experiments designed to test the efficacy of candidate therapeutic strain sWW627.

Male Sprague-Dawley rats weighing approximately six hundred grams were housed individually in metabolic cages (Tecniplast, 3701M081) and fed a high fat (40%) base diet containing 86 µmol daily oxalate per rat. Twenty-four-hour urine was collected daily and analyzed for total oxalate throughout each experiment. Baseline urine oxalate was measured on days 1-2. Starting on day three and continuing for the remainder of the experiment, spinach was added to the base diet, resulting in hyperoxaluria. On day 7, rats were inoculated with no strain, a control strain able to grow on porphyran but lacking the oxalate consumption genes (NB124), or a therapeutic strain able to grow on porphyran and consume oxalate (sWW627). Strains were administered by adding 10$^9$ cfu to the drinking water. Starting on day 12, porphyran was added to the drinking water (and increased throughout the course of the experiment as shown in FIG. 13A and FIG. 13B.)

Strain abundance, measured by enumeration of colony forming units (CFU) per gram feces, is shown in FIG. 13A. As depicted, an increase in strain abundance corresponded with higher porphyran concentrations in the diet. Urine oxalate is shown in FIG. 13B, As depicted, administration of strain sWW627 reduces urine oxalate relative to no strain or the control strain. The reduction in urine oxalate by sWW627 increased as porphyran concentrations in the diet increased.

Example 8—In Vivo Efficacy in a Rat Model of Secondary Hyperoxaluria

To demonstrate that oxalate-consuming *Bacteroides* strains can be used to treat hyperoxaluria, candidate strains were subjected to in vivo testing in a rat model of secondary hyperoxaluria.

Hyperoxaluria was induced in rats via Route-en-Y Gastric Bypass (RYGB) surgery. Rats were fed a diet that included porphyran, calcium and spinach. Urine for each animal was collected and the volume and oxalate concentration was measured each day. Oxalate concentration was measured via the EnzyChrom Oxalate Assay Kit (BioAssay Systems, Hayward, CA). Rats were administered a therapeutic strain able to grow on porphyran and consume oxalate (sWW627, described in Example 7), or a control strain.

Figure 14:
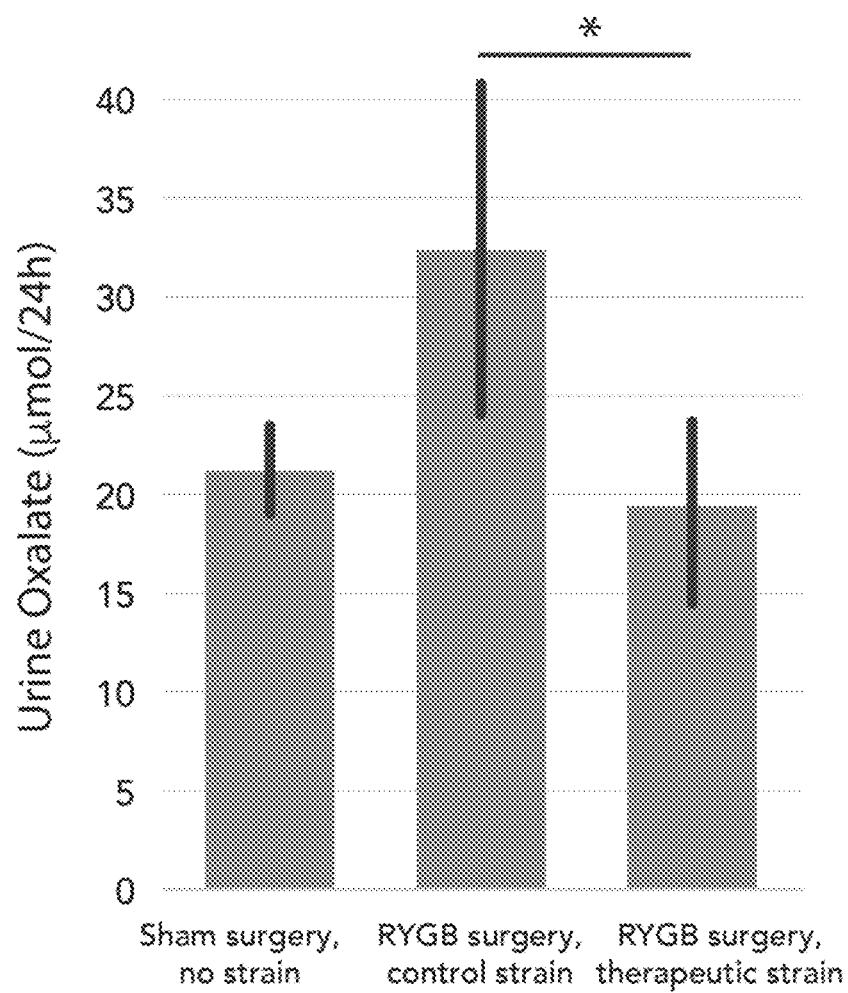
FIG. 14 is a bar graph depicting urine oxalate levels in rats with hyperoxaluria induced via Route-en-Y Gastric Bypass (RYGB) surgery following treatment with the indicated strain. Bars represent the final five-consecutive-day average of total daily urine oxalate of the rats in each group. Error bars represent the 95% confidence intervals (n=5 sham rats, n=8 for all other groups).

Results are depicted in FIG. 14. Rats that received RYGB surgery and were gavaged with a control strain showed a higher level of urine oxalate than rats that underwent a sham surgery. Rats that received RYGB surgery and were administered a therapeutic strain (sWW627) showed reduced urine oxalate relative to rats administered the control strain, and reversed the impact of RYGB surgery.

Example 8—Engineering of Ribosome Binding Sites (RBSs)

Ribosome binding sites (RBSs) were screened from a synthetic library to produce a set of RBS sequences that can be used to tune expression of oxalate degradation genes. For each oxalate consumption gene of interest, over 1000 RBS sequences were screened from a library where the degenerate sequence NNNNNNNNWWWAAAWWTWANAAA was located immediately upstream of the translation start site of each gene. Each gene was also translationally fused at the C-terminus to a luciferase protein. Upstream of each RBS, transcription was driven by the P_BfP1E6 promoter (SEQ ID NO: 68). Plasmids containing the expression cassette were genomically integrated into *Bacteroides vulgatus*, and individual clones of unique RBSs were grown to saturation in BHIS media. Luminescence of each saturated culture was measured with the Nano-Glo Luciferase Assay System (Promega Corporation, Madison, WI).

Figure 15A:
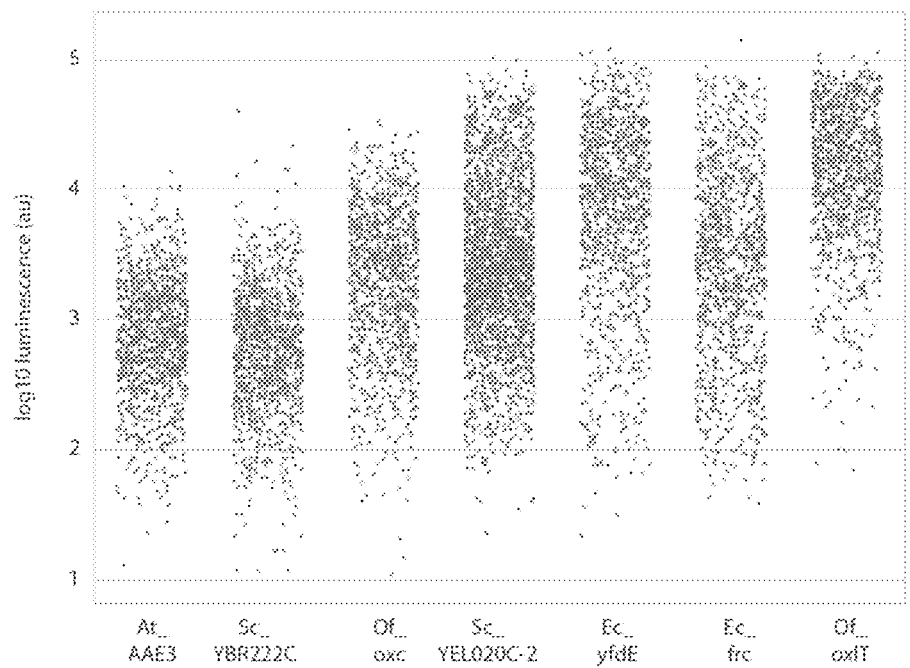
FIG. 15A depicts results from screening of ribosome binding sites (RBSs). Each point represents expression (as measured by log10 luminescence values) for each indicated gene with a different engineered RBS, as described in Example 8.

FIG. 15A depicts the luminescence values for each clone of each indicated gene. Selected clones were isolated and sequenced to determine each RBS sequence of interest. SEQ ID NOs: 96-103 depict an *A. thaliana* OXS coding sequence with eight RBSs of interest. The RBSs in SEQ ID NOs: 96-103 are referred to as RBS1-8, respectively. SEQ ID NOs: 104-111 depict a *S. cerevisiae* OXS coding sequence with eight RBSs of interest. The RBSs in SEQ ID NOs: 104-111 are referred to as RBS1-8, respectively. SEQ ID NOs: 112-119 depict an *O. formigenes* OXC coding sequence with eight RBSs of interest. The RBSs in SEQ ID NOs: 112-119 are referred to as RBS1-8, respectively. SEQ ID NOs: 120-127 depict a *S. cerevisiae* OXC coding sequence with eight RBSs of interest. The RBSs in SEQ ID NOs: 120-127 are referred to as RBS1-8, respectively. SEQ ID NOs: 128-135 depict an *E. coli* ACOCT coding sequence with eight RBSs of interest. The RBSs in SEQ ID NOs: 128-135 are referred to as RBS1-8, respectively. SEQ ID NOs: 136-143 depict an *E. coli* FCOCT coding sequence with eight RBSs of interest. The RBSs in SEQ ID NOs: 136-143 are referred to as RBS1-8, respectively. SEQ ID NOs: 144-151 depict an *O. formigenes* OxlT coding sequence with eight RBSs of interest. The RBSs in SEQ ID NOs: 144-151 are referred to as RBS1-8, respectively. SEQ ID NOs: 152-162 depict a codon optimzed *S. cerevisiae* OXC coding sequence with eleven RBSs of interest. The RBSs in SEQ ID NOs: 152-162 are referred to as RBST-8, RBS1b, RBS2b, and RBS3b, respectively.

Figure 15B:
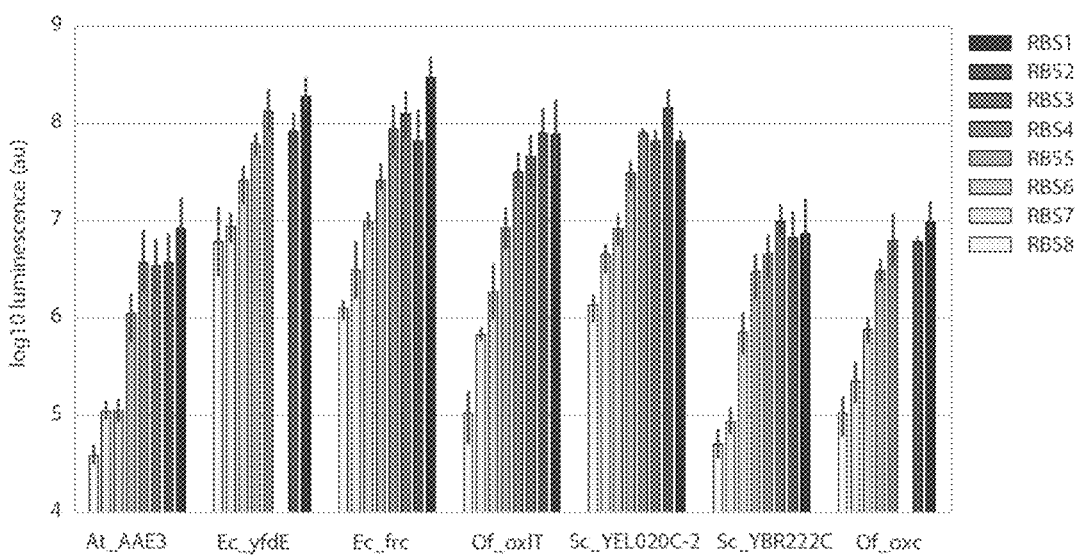
FIG. 15B depicts expression (as measured by luminescence) of the indicated gene with the indicated RBS. Error bars represent the 95% confidence intervals.

Plasmids were reconstructed with the above sequence and genomically incorporated into *Bacteroides vulgatus*. Luminescence of cultures was assayed as described above. Results are shown in FIG. 15B.

Example 9—In Vitro Testing of Oxalate Degradation in Liquid Culture

Engineered *Bacteroides* were assayed for oxalate degradation capacity in an in vitro assay.

*Bacteroides* cells were diluted from an overnight culture 1:10 into BHIS liquid media with 16 mM added oxalate. The cultures were incubated anaerobically at 37° C. After 20 hours, the cultures were centrifuged to separate out the cells, and the supernatant was taken for analysis. Samples were analyzed using a 595 nm oxalate oxidase kit (Sigma-Aldrich, Catalog # MAK315-1KT) and compared to a standard curve in order to calculate oxalate consumption rates.

Figure 16:
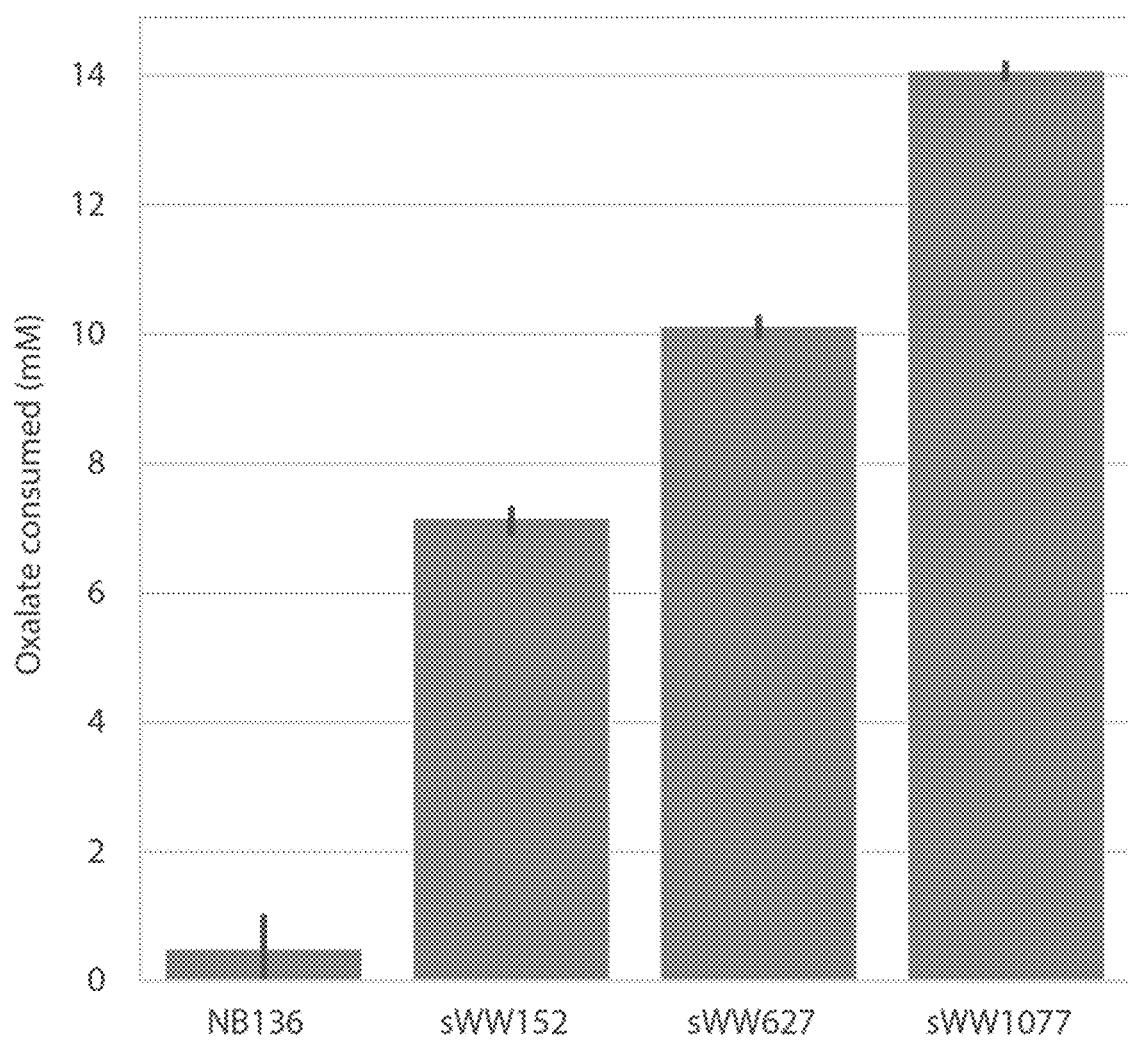
FIG. 16 is a bar graph depicting in vitro oxalate degradation by the indicated strains. Error bars represent the 95% confidence intervals.

Strains tested included NB136 (containing no introduced oxalate consumption genes), sWW152 (as described in Example 4), sWW627 (as described in Example 7), and sWW1077. SWW1077 contains SEQ ID NO: 82, which includes an engineered oxalate consumption pathway along with the engineered RBSs identified in Example 8 (including RBS2-*E. coli* FCOCT (SEQ ID NO: 137), RBS2-*O. formigenes* OXC (SEQ ID NO: 113), RBS2-*O. formigenes* OxlT (SEQ ID NO: 145), RBS1-*E. coli* ACOCT (SEQ ID NO: 128), and RBS1-*S. cerevisiae* OXS (SEQ ID NO: 104)). Results are shown in FIG. 16. As depicted, oxalate consumption of each engineered strain was increased relative to the control strain, and the greatest oxalate consumption was seen for sWW1077

INCORPORATION BY REFERENCE

The entire disclosure of each of the patent and scientific documents referred to herein is incorporated by reference for all purposes.

EQUIVALENTS

The disclosure may be embodied in other specific forms without departing from the spirit or essential characteristics thereof. The foregoing embodiments are therefore to be considered in all respects illustrative rather than limiting on the disclosure described herein.

Scope of the disclosure is thus indicated by the appended claims rather than by the foregoing description, and all changes that come within the meaning and range of equivalency of the claims are intended to be embraced therein.

---

Lengthy table referenced here

US12421518-20250923-T00001

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US12421518B2). An electronic copy of the table will also be available from the USPTO upon request and payment of the fee set forth in 37 CFR 1.19(b)(3).

SEQUENCE LISTING (231 sequences)

SEQ ID NO: 1 - DNA, 1170 bp, Acetobacter aceti
atgactgaaaccacgccagcaaaaccgaaggggccctttgatgggctcctcgttattgatctgacacatgtgctgaatggtccgttcggcacaacaattctaacagatctgggggctcgtacaatcaagatcgagccaccggggcatggggatgatacgcgtacctatggcccatatgttggagatcaatcgctttacttctcttttgtaaacaggggaaaggaaagcattgtccttaacctcaaggatgagggcgatcgagcgatttttctggaaatggtgcgtaaggccgatgtgctggcggaaaacttccgccccggcgtgatggaccgtttgggtttcaattatgaggaactggcaaagatcaatccacggttgatttatgcatcttcatcagggttcggtcagacaggcccgctcgcacattatcctgcctacgatactattgtgcaggccatgagcggcatcatgatggccacgggctttcccgatggtccgccaacgcgggtagggggcacatcgctttctgatctgtgcggtggggttttcatgttctgcggcattgccagtgcgctttatgcgcgtgagcgcacagggaaaggggcacacattgatgtttcaatgtttgatggtaccttggcatttttgcagcatgctctgatgtgctggtctgctacaggcaaagcccctgcgcgtattggcaatcgccatccttatatggcgccttttgatgtgtttcaggcgcaggacaagccttttgtcatctgttgtgggaatgaccatctttttaaggcgctttgcgatgtgattggtgcgcctgaactggcgacagacccgcgttttgtcgaaaatcatgatagaatggccaataatgatgcgctgaaagctgcattggaaaaagcactttccaaacagccagcggcgcattggctggatgttattcacaaagccggtgtgcctgttgggccgttgctggacgtggcagaggcggcaaatctgccacaaacagccgcgcggaatatgctgattaaatctggcggggtgatgatgcccggtaacccggtgaaaatcagtgggtatgatgacccacatgaacggcccggcgcccctaagctggatgagcagggcgcggcgttgcgtaaggaatttgccgcaccagaggcaaaatga

SEQ ID NO: 2 - DNA, 1146 bp, Escherichia coli
atgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataa

SEQ ID NO: 3 - DNA, 1131 bp, Saccharomyces cerevisiae
atgtcgaagggaaaggttttgctggttctttatgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaacaagcaattaatggtgagtgggatattgccggcgtggctaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctggatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 4 - DNA, 1332 bp, Bifidobacterium animalis
atggctgacaaaagcactgccccactggcaggcatcaaggtaatcgactggacgcaggttcagtctggcccttcgtgcacccagattctcgcatggctgggcgccgaggtcatcaagctcgagaaggtgcatggcggcgacccgacccgtaacgagatgaacgacgtcgacggctcgtactcgctgtacttcctgcagctcaacgccaacaagaagtcgatcacgctcgacatgaaggacccggaaggcaagaagatcctcaccgacctgctcaaggacgcagacgtgttcgtagagaacatcggcccaggcgacgtggaaaagctcggcttcggttgggacgaggtccacaagatcaacccgaagctcatcatggcctcgctcaagggattcaaccagggcagccgcttcgaacatgtcaaggccttcgagcctgtcgcccagtgcgcaggcggcgctgcttcgaccaccggctggtgggaaggcgacaagaacatcccgacgcagtccggcgctgcccttggtgattcgaacaccggtatgcacctgacgattgcaatcctcaccgcactgctgcagcgcgagcgcaccggcgaaggcgtgttcgtgtaccagtccatgcagaatgcagtgctcaacctatgccgcatcaagctgcgtgatcagctcattctcgatcacctacaccagctttcctactacgactgctacccgggctacaagttcggcaaagcgattccgcgtgcggccaatgccgagggcggactcgtgctcggctggtgctatcgcgccaagggctgggaaaccgatccgaacgcctatgtgtacattgtgattcagcagtcgcagaagggattcgagaacttctgcaacgccatgggcttccaggattggctcaccgatccgaagttcagcacgccgaacgctcgcgatgagcacaagcaggaagtgtacaagcgcgtcgaggaatacacgatgcagtacgacaagtacacgctcaccaaggaactcggcgccaagggcgttccggtgggcccggtgctcgattggaacgaactcgaaaacgatccggatctcaacgaggatggcacgctgatcacgatcgatcagggcgacgcccgcggcaagttcaagacgatcggcctgccgttcacgatgagcaactatgcgccggattaccagcgcgcgccgaagctcggcgagaacaacgaggagattctcaagtccctcggctacaccgacgagcagatcgccgatctggcgaccaagggcgtcatcggctcgaacgatggcgtcaaggcagacctcaccgccgctccggcacaggcctga

SEQ ID NO: 5 - DNA, 1215 bp, Cupriavidus oxalaticus
atgcctgcacaacacacccatgccacgcccgccggcccgctcgacggcatccgcgtgctcgacctgaccgcggtcgtgctcggcccgctggccacgcaggtgctggccgattttggcgccgacgtgatcaagatcgaggggccggaaggcgacctgatgcgcgccaacggcgtgtcgcagcacgccggcatgagctcgatctacctggcgctgaaccgcaacaagcgctcggtcgtgctcgacctgaaaatccccgagggcgccgaagcgctgcgcgcgctgatcgccggcgccgacgtgctggtgcacaacatgcgcgtggcggcgatcgagcggcttggttttggctacgaggccgtcgcacgcatcaacccgcgcatcgtctactgcgtcgccaccggcttcggccaggacggcccgcaccgcgacaagcccgccttcgacgacatcatccaggccggctgcggactggtggcgctgggcgccggcaacggcgagcggccggaatacgtgcccagcctgatcgccgacaagaccaccgggctggcgctggccaatgccgtgctggccgcgctgctgcaccgcgaacgccatggcgtgggccagtcggtcgaagtgccgatgctggaaaccatggccgccttcgtgatgaccgagcacctgggcgggctgaccttcgagcccgcccccgccggcgcgggctatgcgcggctactgcagggcggccgccgcccggcgccgacgcgcgacggctggatctgcgcgctgccctataccgagcgccactggcatgccttcttccgcgcggtgggtcgcgatgaccttgccgaccgttacgaagtcggcgaccgcgcacagcgcaatgccaatatccgcgcgctgtacggccatcttgccgaactgaccccggagcgcagcaccgcagaatggatggcgctgttcgaagcgctcgacatccccgccacgccgatctacgacctcgatgcgctggtcgaccatccgcacctgcgcgcggtgggactgttccaggccacgcagcaccccaccgaaggcccgctgcgcgaagtgcgcccggccgcgcgcttctcggccacgccgctgtcgttgcgccggcatgcgccggcactgggcgaacacaccgccgaagtcttgcaggaagccggcatcgccctgcccgccgcgcatgccggcacacccgccggcgctcaggaataa

SEQ ID NO: 6 - DNA, 1251 bp, Cupriavidus oxalaticus
atgaacctcccgctcaacggcatcaagatcatcgacttcacgcacgtccaggccggccccgcgtgcacgcagctgctggcatggttcggcgcagacgtcatcaaggtggagcgccccggttccggcgacgtgacgcgcacgcagctgcgcgacatcccggatgtcgacgcgttgtacttcaccatgctcaactccaacaagcgcagcctgacgctggacaccaagaagcccgaaggcaagaagatcctggagcagctgatccgcgagtcggacgtgctggtcgagaacttcggcccgggtgcgctggaccgcatgggcttctcgtgggaacgcatcaacgagctgaacccgaagatgatcgtggcctcggtcaagggcttcagcgacggccatcactatgaagacctgaaggtctatgaaaacgtggcgcagtgcgcgggcggtgcggcgtcgaccacgggcttctgggatggtcctcccaccgtttccgcagcggcgctcggcgattcgaacaccggcatgcacctggccatcggcatcctgaccgcgctgatcggccgcgacaagaccggcaagggccagaaggtggccgtgtcgatgcaggacgccgtgctcaacctgtgccgcgtcaagctgcgcgaccagcagcgcctggaccgcctgggcttcctggaagagtatccgcagtacccgcatggcagcttcagcgacgtggtgccgcgcggcggcaacgctggcggcggcggccagccgggctgggtgctgaagtgcaagggctgggaaaccgaccccaacgcctatatctacttcaccatccagggccatgcctgggagccgatctgcaaggcgctcggcaagccggaatggatcgacgatcccaactacgccaccgccaaggcacgccagccgcatatcttcgatatcttcaacaccatcgaggaatggctcgccgacaagaccaagtacgaggcggtggacatcctgcgcaagcatgacatcccgtgctcgccggtgctgtcgatgaaggagatcgcggccgatccgtcgctgcgcgccagcggcagcatcaccgaggtgccacacaaggagcgcggcacgtacctgacggtgggcagcccgatcaagttctccgacctcaagccggaaatcacgggttcgccgctgctgggcgagcatagcgaagaagtgctggccggcctggggtacggcacggacgacatcaagcgcctgcgcgagtcccaggtgatctga

SEQ ID NO: 7 - DNA, 1251 bp, Escherichia coli
atgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctga

SEQ ID NO: 8 - DNA, 1287 bp, Oxalobacter formigenes
atgactaaaccattagatggaattaatgtgcttgactttacccacgtccaggcaggtcctgcctgtacacagatgatgggtttcttgggcgcaaacgtcatcaagattgaaagacgtggttccggagatatgactcgtggatggctgcaggacaaaccaaatgttgattccctgtatttcacgatgttcaactgtaacaaacgttcgattgaactggacatgaaaaccccggaaggcaaagagcttctggaacagatgatcaagaaagccgacgtcatggtcgaaaacttcggaccaggcgcactggaccgtatgggctttacttgggaatacattcaggaactgaatccacgcgtcattctggcttccgttaaaggctatgcagaaggccacgccaacgaacacctgaaagtttatgaaaacgttgcacagtgttccggcggtgctgcagctaccaccggtttctgggatggtcctccaaccgtttccggcgctgctctgggtgactccaactccggtatgcacctgatgatcggtattctggccgctctggaaatgcgtcacaaaaccggccgtggtcagaaagttgccgtcgctatgcaggacgctgttctgaatctggttcgtatcaaactgcgtgaccagcaacgtctggaaagaaccggcattctggctgaatacccacaggctcagcctaactttgccttcgacagagatggtaacccactgtccttcgacaacatcacttccgttccacgtggtggtaacgcaggtggcggcggccagccaggctggatgctgaaatgtaaaggttgggaaaccgatgcggactcctacgtttacttcaccatcgctgcaaacatgtggccacagatctgcgacatgatcgacaagccagaatggaaagacgacccagcctacaacacattcgaaggtcgtgttgacaagctgatggacatcttctccttcatcgaaaccaagttcgctgacaaggacaaattcgaagttaccgaatgggctgcccagtacggcattccttgcggtccggtcatgtccatgaaagaactggctcacgatccttccctgcagaaagttggtaccgtcgttgaagttgtcgacgaaattcgtggtaaccacctgaccgttggcgcaccgttcaaattctccggattccagccggaaattacccgtgctccgctgttgggcgaacataccgacgaagttctgaaagaactgggtcttgacgatgccaagatcaaggaactgcatgcaaaacaggtagtttaa

SEQ ID NO: 9 - DNA, 1158 bp, Bacillus subtilis
atgaaaaaacaaaatgacattccgcagccaattagaggagacaaaggagcaacggtaaaaatcccgcgcaatattgaaagagatcggcaaaaccctgatatgctcgttccgcctgaaaccgatcatggcaccgtcagcaatatgaagttttcattctctgatactcataaccgattagaaaaaggcggatatgcccgggaagtgacagtacgtgaattgccgatttcagaaaaccttgcatccgtaaatatgcggctgaagccaggcgcgattcgcgagcttcactggcataaagaagctgaatgggcttatatgatttacggaagtgcaagagtcacaattgtagatgaaaaagggcgcagctttattgacgatgtaggtgaaggagatctttggtacttcccgtcaggcctgccgcactccatccaagcgctggaggagggagctgagttcctgctcgtgtttgacgatggatcattctctgaaaacagcacgttccagctgacagattggctggcccacactccaaaagaagtcattgctgcgaacttcggcgtgacaaaagaagagatttccaatttgcctggcaaagaaaaatatatatttgaaaaccaacttcctggcagtttaaaagatgatattgtggaagggccgaatggcgaagtgccttatccatttacttaccgccttcttgaacaagagccgatcgaatctgagggaggaaaagtatacattgcagattcgacaaacttcaaagtgtctaaaaccatcgcatcagcgctcgtaacagtagaacccggcgccatgagagaactgcactggcacccgaatacccacgaatggcaatactacatctccggtaaagctagaatgaccgtttttgcatctgacggccatgccagaacgtttaattaccaagccggtgatgtcggatatgtaccatttgcaatgggtcattacgttgaaaacatcggggatgaaccgcttgtctttttagaaatcttcaaagacgaccattatgctgatgtatctttaaaccaatggcttgccatgcttcctgaaacatttgttcaagcgcaccttgacttgggcaaagactttactgatgtgctttcaaaagaaaagcacccagtagtgaaaaagaaatgcagtaaataa

SEQ ID NO: 10 - DNA, 609 bp, Hordeum vulgare
atgtccgacccagacccactccaggacttctgcgtcgcggacctcgatggcaaggcggtttcggtgaacgggcatacgtgtaagcccatgtcggaggccggcgacgacttcctcttctcgtccaagctgaccaaggccggcaacacgtccaccccgaacggctcggccgtgacggagctcgacgtggccgagtggcccggtacgaacacgctgggcgtgtccatgaaccgtgtggacttcgcgccggggggcaccaacccgccgcacatccacccgcgtgcaaccgagatcggcatggtgatgaaaggtgagctcctcgttggaatcctcggcagccttgactccggaaacaagctctactccagggtggtgcgtgccggagagactttcgtcatcccgcgcggcctcatgcacttccagttcaacgttggtaagacggaagcctacatggttgtgtccttcaacagccagaaccctggcatcgtcttcgtgccgctcacactcttcggctccgaccctcccatccccacgcccgtgctcaccaaggctctccgggtggaggccggagtcgtggaacttctcaagtccaagttcgccggtgggtcttaa

SEQ ID NO: 11 - DNA, 1188 bp, Moorella thermoacetica
atgggtaaagtaaggaatatctctggatgtgtggcggtagcacatggtgtgcggttagccgatgtcgacgttatctgttcctatcccatccggccttataccggtatcatgtccgagctggcacggatggttgccgacggcgagttggatgccgaatttgtccatggcgaaggtgaacacgcccagttgagtgtcgtttacggcgcttcggctgccggagcacgggtattcaccggtagttccggtgtcggcgtaacctatgccatggaagtctattcacctatctctggtgaacgtttaccggtacagatggccattgccgaccggaccctggacccgcccggtgactttggtgaggaacataccgatgccgagtgttgccgggaccagggctggatccagggttgggcctccactccccaggaagccctggataacaccttgatttactaccgggtaggtgaagaccagcgggtcttgttgccccagtatgcctgcctggacgggtacttcgtcagccatatcctaggcccggtggatattcccgacgaggcccaggtgaaagagttcctgccgccttacaagaatcaccatgtcctcgatcccaggaagccccagattatcggccctcaaattgagccggccatgggacctcccctccaataccagcgttaccaggccgttaaaggcgtgcacaaggttctagaagaggcctgtgacgaattcgcccggattttcggccgcaagtacgatccctaccttgatgaatacctgactgacgatgccgaggttataatcttcggccagggcgcccacatggagactgctaaagcggtagcccggcgcctgcgcaaccttggtgaaaaggtaggagtagcgcggctacgtaccttccggcccttcccgacggaacaaattaaagagcgactttctaaattcaaggctattggtgtcctcgatgtttcggccaacttcggcatttcctgcagcggcggcgtcctcctgtccgaactgcgggccgccctctatgactacggcgacaaagtaaagaccgtaggctttgtagccggcctaggcggcgaagtcgtcacccacgatgagttctaccgcatgttccagaaactaaaggagatcgccaagacaggtaaagtcgagcagacctcttattggatcccctttgaattataa

SEQ ID NO: 12 - DNA, 945 bp, Moorella thermoacetica
atgctggatcggattgcatctattaaaaaggcacctgatgaggaatactatgttcccgggcatcgtacctgtgccggctgcggcccggccctgacctatcgcctggtggccaaagccgccggtcccaacaccatcttcattggtcccaccggctgcatgtacgtggccaataccagctacggctgcggtccctggcgggtaccctggatccatgcccagatcaccaatggcggcgccgtggcctccggtattgaggccgcctataaggctatgatccgcaagaagaagaccgacgccgagttcccgaacattatcgttatggccggtgatggcggcgccgtcgatatcggcctccaggcactgtcggccatgctctatcgcggtcatgacgtcctctttatctgctacgataacgagtcctatgccaataccggtattcagacctccccgacgacgccctacggggctaatacgacttttaccccgcctggtgaggtggtaccggagggcaagaagctcttcccgaaggataaccccaaggttatcgcccacggtcacccggaactgaagtatgtcgccacggcctccatcggctggccggtagacctgatgaacaaggtccgtaagggcttaaaccaggaaggtccggcctatatccacatccacgctccttgccccaagggctggcagttcccggccgacaagaccattgaaatggccaaattggccgtccagacgggcatgttccagctctacgaatatgagaatggtgagtataaactgtcggttaaagtcgataaacggaaaccggtcagcgagtacatgaaactccagaagcggtttgctcacctgaagcccgagcatatcgccaagatgcaggcctttgtcgacgcccgctgcgctgaagtaggtatcaccgtgccggtagtcgcttccaacgcttaa

SEQ ID NO: 13 - DNA, 948 bp, Moorella thermoacetica
atgtccaccaaagatctctttgctgaacccaatctcaagcagattactgtgtgggcccggggcgttgtcatgaacaaggacgcccgtgatatcgtggtggccctgacagaagcggctgccaaagagggtaaatatgttcaggcctgggagaactatgttgacctccccgaccggatctacgtcccggtaagggcctatgcccgcatcagcagcgatcccattgaaagcaaatacatttacgagaatgagactcccgacattgttgttttagttgaagaatccctgatcaaaggagtgcccatactgaagggcatccgtccgggtagtaccctggttgtaaataccaaacgttccatagatactatccttgagttcctgggtgataccggcaatctggcccaaatcgtaacggtggatgccaacagtatggccgaggctgtcatgactttgtctggcgctgaaggcgctactgacgctacgggtattggcgccggcatagcggctcccattgcgggtgctgttgtcaaggctacaggtatagttgatgttgaaaacctcgccgctgtggtcaagaatcccgccgccatgcgccggggctatgcggaagcccaggtgcgccagctgccgccccatgaagcagttgaggaagcggccgtatcagcgactgaattgttgaggcaaatgccctttgccgggacggttccctcaccggtaacggagaatgagggcatggtaaccggcaactggcgcatccaaaggcccattatcgaccgggaagcctgtaccgaatgttatacctgctggatctactgccccgattcctgcatcaccaggaccgaagaaggaccggtatttaatatgaagtactgcaagggctgcggcctctgtacggcggtctgccccagcggcgccctgactaatgtaccggaacttgacttcaaagattaa

SEQ ID NO: 14 - DNA, 1545 bp, Arabidopsis thaliana
atggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctga

SEQ ID NO: 15 - DNA, 1587 bp, Methylobacterium extorquens
atgactatgttattacctgaaccatcagctttgttaccaacagattcaaaggaagcctcagtcccagcaacaacattgcatgagttgatacaagctggtgcagacgctgcccctgccttatcttctccaggaggagtaccattaacctttcaagcattaagagccttaaccgagagaaccgtcgccgacttgaacgcaaggggtattggtagaggtgatagagttgccattgttttgccaaatggaccagaaatggctgcagctttcattgcagtagcagccggtacaacttcagcacctttaaatccttcttacaaggcggacgaatttgagttctatatgtcagatttaggtgcaaaattattattagtcgcagagggttctgagactcctgccgttgccgtggctgagaaattgggtgtttcagtagctagattaagaccaactccagatgaaggagcaggttcttttactttacattttgcctcagagtctactggtccaaccgaaaagtcaggtcctgcaggttcagatgatatagctttggtattgcacacatcaggtaccacatctaggcctaagattgtcccattgactcaagcaaatgtatgcgcatctgctagaaacattaggactgcattagcctttggcccggaagatagaggattaaacataatgcctttgttccatatacacggattaatcgctggaattttagccccattatctgtcggtggtcaagtctcttgcactccaggtttcaacgcattgaaattctttggatggatggatgaagtcaatccaacctggtacaccggagtaccaacaatgcatcaagccattttaggaagggcagcaagaaataaagaaattatcgccaggaaccctttaagatttatcagatcttcttcatcatctttgccaccacaagtcatgaaagagttggaggaaaccttcggtgctcctgttattgaagcatacggaatgaccgaagctgcacatcaaatggcctcaaacccattacctcctaagcctcactatgctggttctgtaggtttggctgcaggtcctgagattgctgttgtcgacttagacggtgaacctttaccagctggagagacaggtgaaatagtcataagaggtgacaacgttatgaagggttacgaaaacaacgagaaggcaaatgcagaagcattcaccaagcagggttggttcagaactggtgaccaaggtgtcttgtctccagagggatacttatctatcactggaaggttaaaggagataatcaataggggtggtgagaaaatctcaccaagagaagtagatgaaattttgatggaccatcctgcagtatcacaatgcgttacatttgcggttcctcatgataaattgggtgaagatgttgctgctgccatcgtcttaagggagggtgttgaagccgttgaaaaggacattcgtagcttcgcttcagaaagattagcagcatttaaagtacctgccaaaatcttaattttggatgaaatcccaaaaggtgccacaggtaagttgcaaagaataggtttggcacagaaattgggattggtttaa

SEQ ID NO: 16 - DNA, 1632 bp, Saccharomyces cerevisiae
atgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtaa

SEQ ID NO: 17 - DNA, 1104 bp, Bifidobacterium animalis
atgacaaagatattgatagacgacatcatccccatcatcgtcatcatggcgttgggctatgtctgtggaaaactcagctacttcgacaacgatcagcgtcagggcctcaacaagctcgtgctgaacatcgccctccctgccgcactgttcatctcgatcgtcaaggcgacccgtgagatgctcgcacaggatgcggtgctcacaattctcggcttcatcggcatcatcgtgatgttcatgttgagctactacctgtgccgactgatgttccaccattcgatccaggaagcggccgtatgcgcgttgatcgccggctcgccgaccatcggcttcctcggcttcgccgtgctcgacccgatctacggcgacaccgtgagcacgaacctcgtcatcgcgatcatctcgatcgtcgtcaacgccgtcacgattccgatcggcatgtatctgatcaacctcggccagagcaaggatcgcgagcgcctgtcgaaggccgccgtcacgaactcgaagggccaggtcagcatcgccaatccgaaggacgatatcgccgtcgatccgaacaaggatgcgaagaccgacaagacggcagaggtgatgatctccaagtcgtcgaacatgggcaagaagaagaaccagaacctcgaagcgctcatcaacgcactcaagcagcctgtgtgctgggctccgctgctcgccatcgtgctcgtgctcatcggcgtgcgcgtgccgtccggtttcgctcccaccttcgacctgattgccaaagcgaactccggtgtcgccgtgctggccgccggcctcgcgctctccactgtgaagttctcgctgggctgggaaacgatctggaacacgttctaccgcttgattctcacccctgcggcattcctcggcgtcggcctgctgctgggcatgggcagcaatgtgaacaagctctccatgctcgtcatggctgtggccctgccgcctgcattctccggcatcatcatctcgagccgctacaacatctacgtcaaggaaggtgcgtcgaccaccgcggtttccacggttgcgttcgccgtcacctgcctgctgtggatctggctcgtgccgctgtgctgccactga

SEQ ID NO: 18 - DNA, 1323 bp, Cupriavidus oxalaticus
atgagtaacgcaacggcaggggccctgagccccaatcagggagcttcggaatccacgcgctggatccagctgctcgtcggcgtggtctgcatgatcgccacggccaacatccagtacgcctggacgctgttcgtgcctgagatccaggatacctacggctggtcacgcgccagcatccagattgcctttaccgtgttcgtgctggtgcagacctggctggcgccgatcgagggctacttcatcgacaagttcgggccgcgcatgatggtggccttcggcgcgctctttatcggcacggcgtgggtcatcaactcgcaggcgaccacgctgatgggcttctacgtcggcgccgccgtcggcggcctgggcgtgggctccatctacgcgacctgcatcaacaacgcgctgaagtggttcccggaccgccgcggcctcgcggtcggcctgaccgccggcggctatggcgcgggctcggcggcgaccatcctgccgatcgcggcgatgatcgagtcgcagggtttccagcacaccttcctgttcttcggcctgctgcaggggtcgctggcctttgtcgcggcgtggttcctgcgctcgcccaagaccggcgaggtgcgggggtcgaagaagctggcccaggccacgcgcgactacaccctcaaggaagcgctgtgcaccaggctgttctggctgatgctggtgatgttcgtgctggtggtcacgggcggcatgatggccgtggcgcagctcggtgtcatcgccaaggaccttggcgtgaaggaattccaggtcgacctgcacttcttcgtgatggctgcactgccgctcgccctgatgctggaccgcatcatgaacggcatctcgcgtccgctgttcggctggatctcggacaacatcggccgtgaaaagaccatggtgatcgcctttacgctggaagggctgggcatcatcgcgctgggctacttcggcagcaacccgtacgccttcctgatcctgtccggcgtggtgttcctggcctggggcgaagtctactcgctgttctcggcactggcgggcgatgccttcggcaccaagcacatcggcaagatctacggcgtgctgtacaccgccaagggcatcggcgcactgttcgtgccgatcggcaacctgctgatggaagccaccggcacgtggtcgacggtgctctacacggtggcggtgatggacctgaccgcggcgttccttgccatcatggtgctgcggccggtgcttgcctcgcacgttgcgacatcgaggcagcggtttgcgcaggaatctgccgcggccggcgcgcaagtggcggcttga

SEQ ID NO: 19 - DNA, 1320 bp, Cupriavidus oxalaticus
atggaattgcagcagagggagtccacgtcgcgctttgcgtcgccgtgggtgcaattggtctttggcgtgatctgcatggcgatgatcgccaacatgcagtacggctggacgctgttcgtcaacccgatcgacgacaaataccactggggccgcaccgcgatccaggtggcattcaccatcttcgtcgtgacggaaacctggctggtaccgatcgagggctacctcgtcgacaagtacggcccgcgcccggtagtggtgggcggcgggttgctgtgcgccatcgcgtgggcgctgaactcggtggcgtcctcgctgccgatgctgtacttcgcggccgcaatcggcggcgtgggtgccggcgcggtctacggcacctgcgtgggcaatgcgctcaagtggttccccaaccggcgcgggctggcggcgggcattaccgcagcaggctttggcgctggttccgcgatgaccgtggtgccgatcgccaacatgatcaagacctcgggctatgaagccaccttcctgtggttcgggctggggcagggcctgatcgtcttcatcctcggcctggccctgtatccgccgtcggccaggatcctgagcgaggtcaagaccacgctcaaggccgccgcgacctacaacgccacgccgcgccaggtgctgaagtcgccgatcttctggatcatgtacgccatgttcgtgatgatggccgccggcgggctgatggccaccgcgcagttgggcccgatcgccaaggacttcggcctgcatgactcgccggtgtcgatcctcggcctgacgctgcccgcgctgaccttcgcgctgaccatcgaccgcgtgctcaacggcctgacccgcccgttcttcggctggatctccgaccatatcggccgcgagcgcaccatgttcttcgccttcgcggtggaggcggtcggcatcctgctgctgtccaagtacggccacaacccggtggcgttcgtggtgctgaccggcatcgtgttctttgcctggggtgagatctacagcctgttcccggccacctgcggcgataccttcggtcccaagttcgccgccaccaacgccggcttgctgtacaccgccaagggcacggctgcgttgctggtgccgttctccagcgtgatcaccgccgccaccggcgactggcacgcggtgttcatgctcgcctccggcatggcggcgctgtcggcggtgctggcgctgttcgtgctcaagccgatgcgtgaagcccatgcccgcaagtatgtccacgccaataccgcggcgccgatgggctatcgtgccgtgcaggaagacctgacctga

SEQ ID NO: 20 - DNA, 1209 bp, Escherichia coli
atgacaccttcaaattatcagcgtacccgctggctgacactcatcggtactatcattacccagtttgcgctggggtcggtttatacctggagcctgtttaatggcgcgctttccgccaagctggatgcgccggtaagccaggtcgctttctctttcggcttgttaagtctggggctggcaatttcgtcttctgttgcgggcaaattacaggaacgttttggcgttaaacgcgtcaccatggcttccggcattttgctgggattaggcttcttcctgacagcgcattctgacaacctgatgatgctgtggttaagcgccggtgtgctggtgggactggcagatggcgcgggttatctgctgacgctctctaactgtgtgaagtggttcccggagcgtaaaggtctgatctccgcgttcgctatcggttcttatggtctgggtagcctgggtttcaaatttatcgacacgcagctgctggaaacggtcggtctggaaaaaacctttgtgatttggggagcgattgcgctgttgatgattgttttcggcgcaacgttaatgaaagacgcaccaaaacaggaagtgaaaaccagcaatggtgtggtggagaaagattacacgctggcagagtcgatgcgtaaaccgcagtactggatgttagcggtaatgttcctgaccgcctgcatgagcggcctgtacgtgattggggtagcgaaagatatcgcccaaagtctggcacaccttgatgtggtttccgcagccaatgcagtcactgttatttccatcgccaacctttcaggtcgtctggtgctgggtattctgtctgacaaaatcgcccgtatccgtgttattaccattggtcaggtgatatcgctggtgggtatggcggccctgctgtttgcaccattgaatgcagtgacgttctttgcagcgattgcctgcgtggcatttaactttggcggcactattaccgtctttccgtcactggtcagtgagttctttggcctcaataacctggcgaaaaactacggtgtgatttatctcggtttcggtatcggtagcatttgtggttcgattatcgcctcactgtttggcggcttctatgtgaccttctacgtgattttcgccctgctgattctgtcattggcgctttctacgacgattcgtcagccagagcagaaaatgttgcgtgaggcgcatggctccctttaa

SEQ ID NO: 21 - DNA, 1257 bp, Oxalobacter formigenes
atgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattag

SEQ ID NO: 22 - DNA, 1773 bp, Bifidobacterium animalis
atggttgatgtaagtgtaactgctacaagctcagaccagaatctcacggattctccccactacctcgccgaaacgctcatcaagaacggtgtcaagcatatgtacggcgtcgtcggaatcccggtcactgatttcgcacgtatcgcacagggcatgggcatccgcttcatcggcatgcgccatgaggaggacgcggtgaacgctgccgctgccgaaggattcctcaccggtcgcccagctgtggcgctcaccgtttccgcgccgggcttcctcaatggtctggcaccgctgcttgaagccaccacgaacggcttcccggtcatcatgatcggcggttcgtccactcgccatgtcgtcgacatgcacgaaggcgaatacgaaggcctcgaccaaatgaactatgcgaagcagttctgcaaggaatcgttccgcatcgacaagatcgaagacattccgcttgctgtggcccgcgccatgcacatcgcatgctccggccgtccgggcggtgtctacatcgatttcccggacgacgccgtcgcccagacgctcgacaaggatgtcgccgagtcgcagctgtgggtcgcgaaccagccggctccggcaatgccgccggcgcagtcctctgtggatgaagcgctcaagctgctctccgaggccaagaaccctctcatgcttgtgggcaagggtgcggcgctggcccaggccgaggacgaactgcgtgaattcgtcgagaagaccgacatgccattccagccgatgtcgatggccaagggcgtcattccggacgatgacccacactgcacggcgagctgccgcggactcgcgctgcgcaccgccgacgtcgtgctgctcgtcggcgctcgtctgaactggatgctcaatttcggcgagggcaaggaatggaacccgaacgtcaagttcatccagatcgatatcgacccgaacgagatcgagaacgcccgttccatcgcatgcccggtggtcggcgacatcaagtccgccatgcagatgatcaatgccggactcgagaagacgccagtgaaggcgtccgcgcagtggctcgacatgctcaaggccgacgccgagaagaacgatgccaagttcgccgcccgcgtgaactcgaacaccgtgccgatgggtcactacgacgcgctcggcgccatcaagaaggtgtacgaccagcacaaggacatgatcctgaccaacgagggcgcgaacacgctcgacgattgccgcaacatcatcgacatctaccagccgcgccatcgtctagactgcggcacgtggggcgttatgggctgcgcggtcggctattcaatcggcgccgcagtggccaccggcaagcctgtcctgtacgtcggcggtgattccggcttcggctttgacggcatggaagtcgaggtcgcctgccgctacaatctgccgatcaccttcgtcgtgctcaacaacggcggcatctaccgcggcgatttcgagaatctcggcgacgacggcgacccgtcgccgctgacgctgagctacgacgcccactacgagcgcatgatcgaggcgttcggcggcaacggctattacgcgaccaccccggcggaagtcgagcagatggtcggcgaggccgtcgcctccggcaagccgagcctcgtgcacgtgcagctcgccgattatgcgggcaaggagtccgggcacatctccaacctgaacccgaagcccgtcgtcggcccgctcgccacttccgaaatgaccgcgaacccctacctcaagggcgcccatatgtga

SEQ ID NO: 23 - DNA, 1740 bp, Cupriavidus oxalaticus
atggcagaagtcggaaacgagctgcagcgtcacgccgcggaagagcatcaggcacaaaccgatggttttcatctggtcatcgacgcgctgaagctgaacggcatcgaaaacatctacggcctgcccggcattccggtcaccgacctggctcggctggcgcaggcaaacggcatgcgcgtcatcagcttccgccacgagcagaacgcaggcaacgccgcagcgattgccggctttctgacgcaaaagccaggcgtttgcctgaccgtgtctgcgccagggttcctgaacgggctcacggcgctggcgcatgcgaccaccaactgcttcccgatgatcctgatcagcggctcgagcgagcgcgagatcgtcgatctgcagcagggtgactacgaagagatggaccagctggccatcgcccgtccgcacgccaaggctgccttccgcgtgctgcacgccgaagacatcggcgtcgggatcgcgcgtgccatccgtgccgccgtgtcgggccgcccgggcggtgtgtacctggacctgccggccaagctgctgggccagtcgatggaagccgagaagggccgcaagtcgctgatcaaggtggtggatccggccccgcgccagctgcctgctccggactcggtcgaccgtgccgtcgcgctgctgaagagcgccaagcgcccgctgatcctggtaggcaagggtgctgcgtacgcacgcgccgaagcggatatccgcacgctggtcgagaagacgggcattccgtacctgccgatgtcgatggccaagggcctgttgcccgatacgcacccgcaatcggcctccgccgcacgctcgtatgtgctggccgaagccgacgtggtgctgctggtcggcgcccgcctgaactggctgctgtcgcacggcaagggcaagacctggggcaagccgaagcaattcatccagatcgacatcgcgccgaccgagatggacagcaacgtcgccatcgccgcgccggtcgtgggtgacatcggttcgtgcgtgtcggcgatcctcgacaaggtcggcgacgactttgccaggccgggcgccgactggctgaacgcggtggctgaccgcagggacaccaacctggcgaagatggccgaaaccctggccaggtccagggacgcctcgccgatgaacttccacggtgcgctcggcgtgctgaaggatgtggtcaaggccaacccgaacatctcgttcgtcaacgaaggcgccaacacgctggactacgcccgtgccgtgatcgacatgtacgagccgcgcaagcgcctggacgtaggcacctggggcgtgatgggcgtgggcatgggctacgcggtcgccgccgcggtcgaaaccggcaagccggtgctggcgctgtgcggtgacagtgcgttcggcttctcgggcatggaagtcgaaacgatctgccgctacaacctgccggtctgcatcgtcattttcaacaacaacggcgtctacaaggggatcgacgtgaatccgaccggcggcagggatccggcggtcacgacgttcgtcccgggcgcgcgctacgacaagatgatggaagcgttcggtggtgtcggtgccaatgtcaccacgccggcggaactcgaagccgcggtaaacgaagcgctgcgctcgggcaagcccacgctggtcaacgccgtcatcgacccggctgccggcaccgaaagcggtcgcctgaccaatctgaatccgcaaagctcggccaagaagtaa

SEQ ID NO: 24 - DNA, 1695 bp, Escherichia coli
atgtcagatcaacttcaaatgacagatggtatgcatatcatcgttgaagcattaaaacagaataatattgacactatttatggtgttgtaggtattcctgtgacggatatggcacgccatgcccaggcggaaggcattcgttatattggttttcgtcatgagcagtcggcaggctatgccgctgcggcaagcggttttcttacccaaaaaccggggatctgcctgacagtttctgcgccaggattcctcaatggtttgaccgcattggccaacgcaacggtaaatggttttccgatgatcatgattagcggctccagcgaccgcgcgatcgtcgacctacagcaaggtgattatgaagagctggaccaaatgaatgcggcaaaaccgtatgccaaagcagcatttcgcgttaatcagccgcaggatcttggcattgcattggcacgcgctatccgggtttctgtatcgggtcgccctggcggagtttatcttgatttgccagcaaatgtcctggccgcgacgatggaaaaagacgaagcgttaaccacgattgttaaagttgaaaatccgtcgccagcattattgccatgcccgaagtcagtcactagcgcaatttcgcttttagcaaaagctgaacggccattaattatccttggcaaaggcgcggcgtattcacaagctgatgaacagcttcgtgaatttattgaaagtgctcagattccattcctgccaatgtctatggcgaaagggatccttgaagatacgcatccactttctgcggcagctgcgcgttcgtttgccctggcaaatgctgacgttgtcatgcttgttggtgcacgactgaattggttattggcacacggtaaaaaaggatgggcggcagatacacagtttattcaactggatattgaaccgcaggaaattgacagcaaccgccccattgctgtgccagtcgttggtgatattgcatccagtatgcaaggtatgctggcagaactgaaacaaaacacatttacgactccactggtatggcgcgatattttaaatatccacaagcagcaaaatgcacaaaaaatgcatgaaaaattaagtacagatactcaaccattaaattactttaatgcattaagtgctgtgcgcgacgtattgcgcgagaaccaggatatttatttagttaatgaaggtgcaaataccctggataatgcacgaaatattattgatatgtataaaccacgtcgtcgtctggattgtggtacctggggtgtcatgggcatcggtatgggctatgccatcggtgctagcgtgacttctggttctccggttgtcgccattgaaggtgatagtgcttttggtttcagtgggatggaaattgaaacgatttgtcgatataacctgccggtgacgatcgttatttttaataatggcggcatctacagaggagatggtgttgatctcagtggcgctggtgcaccatcaccaacggatctgttgcaccatgcaaggtatgacaaattaatggatgcgtttcgtggcgttggctataacgtcaccacgacagatgaacttcgtcatgctttaaccaccggtattcagtcgcgcaaaccgaccattattaatgtggtcatcgaccctgcagcaggaactgaaagtggccatattaccaaacttaacccaaaacaagtcgctggtaattaa

SEQ ID NO: 25 - DNA, 1707 bp, Oxalobacter formigenes
atgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaatag

SEQ ID NO: 26 - DNA, 1683 bp, Saccharomyces cerevisiae
atgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatga

SEQ ID NO: 27 - DNA, 1008 bp, Methylobacterium extorquens
atgtcaattgccattgttggtgccggtgcaattggaggatatttaggtgtcagattagctgaagctggtgaggatgttacattcatagctagatctaatgctgcagccatacaagcagatggaatgagattgattgaagaggatgggaccgaaattcactctaaatctgtcaaagccactcgttcaatgcaagaagcaggagttcacgaggttgttttattaacagttaaggcacaccaagttggtcctatagctgccgatttacatcacttgataggtccagacaccgtagtcgtcactatgcagaatggtattccttggtggtactttctaggtggatactctggagatcatgcaggaacaaggttggaatcagctgatccaggaggtttaattgctgatcatttagaccctaagcatgtcattggttctgttgtttaccctgcaactgtattgacagacccaggtactgttaaagttatcgagggtaataggtttggtttgggagaattggatggttcaaaatctgaaagagttttagccttatctcagaggttagcaagggccggttttagagccccagtcacttcagacattagagcagagatctggttgaagttgtggggaaatttatctttcaatcccattagcgccttaacacatgcaaccttggaggacatctgtagatttcctgatactagggctatcgccgcagagatgatgagagaggccgaagtcatcgccaataaattgggtgtaacatttagattaggaatagataagagaatagctggagctgaaaaggtcggtccacacaagacctctatgttgcaagacgtagaagctggtagaccaattgagttggaagccttagtcggatctgtaatcgaattaggaaggttaactggtactcctactccacatattgatacagtctttgctttgatgagattattggcccaatctttagaaagagcacaaggtagattggctattcagggagcataa

SEQ ID NO: 28 - DNA, 1197 bp, Cupriavidus oxalaticus
atgacgcaatccaacctgcccgatttgcccgacctgccgctgaccggcctgcgcgtgatcgatttctcgcgcgtgctggccggcccctattgcaccgcgctgctcggcgacctcggcgccgaggtgatcaaggtcgagccgcccggcggcgacgactatcgcgcggtgggtcccttcgccggcggcaagagcggcctgttctgcgcgatgaaccgcaacaagcagagcatcgtgatcgacctgaagacggaggacggcctggctgtcgcccgcgcgctgtgccgcggtgccgacgtggtggtggaaaacttccgccccggcgtggccgacaagcttggcatcggctacgccgcgctgcgcgaactgaacccctcgctggtctatgccagcgtgtcgggcttcggccagaccggcccggaatcgcaccgcccggcctacgacatcatcctgcaggcgatgtgcgggctgatggacgccaccggcgcgcccgacggcgcgccgaccatgcttggcgaagccgtgtccgatgcggtcagcggcctgttcgcctcgtggggcgtgctggccgcgctgctggcgcgcgagaagacagggcgcggcacgcatgtcgatgtgtcgatgttcgatgccacgctcagcctcagcgccacgctggtcgcgcgctacgcggccaccgggctggcgccgcggcgcgtgggcaaccgccacccgtcgtcggcgccgtttggcgcctaccgcgccgcggatggcttctacgtggtcgcggtgctgaacaacaagctgttccaggcgcttgccgacgccatcggccggcccgcgatggcgcacgacccgcgctttgccgatgacgaaacgcgctgccgcttcgagtccgacctgcgcgccatgctggaaaactggtcggccacgcgcacggtggcggaggtgaacgcagcgctcggcgccgccggcatcccggtcgcaccgatccgcaatgtcaaggaagcgctggaaagcgagcacgcggcgcatcgccgcctgctgaccgaggtgcccgacacggacggcggcaccgtgcgcctgccgtcgcagccggtcaagttctccgcgtacggcaccaaccgcgtgacgcccgcgccggcactgggccagcacaccggggccatcctggccgcgcccgatttcagtaatttcaataaggagaagcaacatgcataa

SEQ ID NO: 29 - DNA, 1221 bp, Cupriavidus oxalaticus
atgggagccttaagccatctccgcgtcctcgacctgacccgtgtccttgccgggccctggtgcgcccagaaccttgccgacttcggcgccgatgtgatcaagatcgagcgccccggcgccggcgacgacacccgcacctggggcccgccctggctcaaagacgaagacggccgcgacaccgccgaggccgcctactacctggccgccaaccgcaacaagcgctcggtcacctgcgacatcagcacgcccgaaggccagcagatcgtgcgcgacctcgccgcgcagagcgacgtggtgctggagaactacaaggtcggccaactcaagaaatacgggctggactacgagtcgctcaggcaggtcaagcccgacctgatctactgctcggtcaccggcttcggccagaccggcccgtacgccgcgcgccccggctatgacttcatcatccagggcatgggcggcttcatgagcctgaccggcgagcgcgacgacctgcccggcggcggcccgcagaaggccggcgtggcgatttccgacctgatgacgggccagtacgccaccatcgccgtgctggcggcgctggcgcatcgcgagcgcaccggcgaaggccagtacatcgacatggcgctgctggacgtgcaggtggccatgctggccaacatgaacaccaactacctggccagcggcgaggcgccgcgccgctggggcaatgcgcaccccaacatcgtgccctaccagaccttccaggccgccgacggctggatcatcgtcgcggtgggcaacgacgggcagttccgcaagttcgtcaccgacggcggcatgcccgaactggccgacgatccgcgctttgccaaaaacccgcagcgcgtggccaaccgcgacgtgctggtgccgatcctggccgagatggtgcgcccgcgcacccgcgcgcagtggatccgcgacctggaagccgcgggcgtgccgtgcggcccgatcaacacgctcgacgatgtgttcgaggacgaccaggtcaaggcgcgcggcctgcgcgtggacctgccgcaccccagcgccggcgaggtcaagctggtcgccagcccgatcaagatgagcgcgacgccgccgcaggcgctgcgccacccgccgctgctgggcgagcacaccgacacggtgctggccgaaaccctgggctacagcgccgggcagatcgcggcacttcgcgcaaaaggtgtgctgtaa

SEQ ID NO: 30 - DNA, 1518 bp, Cupriavidus oxalaticus
atggacaaggaacgcattcgcctggcgaggctgcatgacaaggtagtctcggccgacgaggccgccgcgctgatccgcgacggcatgaccgtaggcatgagcggtttcacccgcgcgggcgactgcaaggaagtcccgttcgcgctggcgcggcgcgcggcgaccgagccgctgcgcatcaccctgatgacgggcgcctcgctcggcaacgacatcgaccgcgtcctggccgaggccgacgtgatcgcgcgccgcctgccgttccagtccgatggcacgctgcgccgcaagatcaacgccggcgaggtgatgttcatcgaccagcacctgtccgaaaccgtcgagcagctgcgttccggccagatcgcgccggtggacgtggcggtggtcgaggccgtggcgattaccgagcagggcggcatcatccccagcacctcggtgggcaattcggcaagctttgccatgctggcgcgcaaggtgatcgtcgagatcaacatgaacatgccgctggagctggaagggctgcacgacatctatttcccggtccagcgcccgtaccgccagccgatcccgctgatcgcgccggaacagcgcatcggactcccgtatattccgatcgatccggagaagattgccgccatcgtcatcaccgccaaggacgacagcccgtccaatgcgctgccgccggacgacgaaacccgcagcatcgccggccacctcaatgacttcctgctgcgcgaagtgcgcgcgggcaagctgtcgccgtcgctgcagccgctgcaggccggcatcggcaccattgccaatgccgtgctgcacgggctggtcgagtcgccgttccgcgacctgaagatgtattccgaggtgctgcaggacagcaccatcgagttgctcgatgcgggccggctgtcgttcgcgtcggcgtcgtcggtgacgctgacgcgcgaggtctaccagcgcttcctgtcgaacctggaccgctaccgttcgcgcctgctgctgcgcccgcaggagatcagcaaccatcccgagatcctgcgccggctggggctgatcaccatcaacaccgcgctggagtgcgacatctacggcaacgtcaactccacgcatgtgggtggcacgcacatgatgaacggcatcggcggctccggcgactttgcgcgcaatgcgcacgtgtcggtgttcgtgaccaagtcggtggccaagggcggcgaagtctcgagcatcgtgccgatggtggcgcacgtggaccacaccgagcacgatgtcgacatcatcgtcaccgagcacggcctggccgacctgcgcggcctggcaccgcgcgagcgcgcgcgcaccgtcatcgccaattgcgccgatccgcaataccgcgagttgctgggcgactatttccgccgcgccagcgcccacggcggccagacgccgcacctgctggaagaggcgttgtcctggcatgtcggcttgcgcgatcgcggcaccatgcggtccgcacagccggcgcaggccctggctgcctga

SEQ ID NO: 31 - DNA, 1212 bp, Cupriavidus oxalaticus
atggtcaacgaagcgaacaaggaaaagatgccgctgcaaggcgtgcgcgtgttggagctgggatcgctgatcgccggcccgtatgccggcggcctgctcgcccagttcggcgccgaggtgctgaagatcgaagcgccgggcgaaggcgatccgctgcgcaaatggcgcaagctgtacgagggcacctcgctgtggtggtacagccagagccgcaacaagaagtcgctgacgctggacctgcgcagcgcgcaaggccaggacatcgtgcgcaagctggtggccggcgccgatatcgtgatcgagaacttccgccccggcacgctggagaaatggggcctgggctgggaagacctgcgcaaggtgaatccggccctggtcatggtgcgcatttccggctatggccagaccggcccctacaaggaccgcccggggtttgccgcgatcgcggaatcgatgggcgggctgcgctatgtcagcggctaccccgaccggccgccggtgcggtccggcgtcagcatcggcgacacgctggcgtcgctgtacggcgtgatcggcgcgctgctggccatgcaccatctgcgcaacaacgatggcgaagggcagtttgtggacgtggccctgtacgagtcggtctttgccgtgatggaaagcctggtgccggagttcgacaagttcggccatgtgcgcgagcgttccggcgccagcctccccggcatttcgccgtcgaacacatatccctgccaggatggacagtacgtgatcatcgcgggcaatggcgacgccatcttccggcgcttcatgacggcgatcggccgcgacgacctcggccaggatccgcgcctggctcacaacgatggccgcgtgcagcacaacgccatgctcgacgacgccatcgccgcatggaccgccgcgcacgacctcgacaccgtgctggcgacgctggaagccgcggcggtgccttgcgggcgcatctacaccgcgcaggacatctgcagcgacccccactacagtgcgcgcggcatgatcgagccgcaccagcttccggacggctcgccgctggccctgtcgggcatcgtgcccaggctcagtgaaacccccgggcgtaccaactggatcggcccggcgctgggcgagcacaccgaagagatcctggcgggcatcggcattgccggcgccgaattccgcgcgctgcgcgaggccggcgtggtctga

SEQ ID NO: 32 - protein, 389 aa, Acetobacter aceti
MTETTPAKPKGPFDGLLVIDLTHVLNGPFGTTILTDLGARTIKIEPPGHGDDTRTYGPYVGDQSLYFSFVNRGKESIVLNLKDEGDRAIFLEMVRKADVLAENFRPGVMDRLGFNYEELAKINPRLIYASSSGFGQTGPLAHYPAYDTIVQAMSGIMMATGFPDGPPTRVGGTSLSDLCGGVFMFCGIASALYARERTGKGAHIDVSMFDGTLAFLQHALMCWSATGKAPARIGNRHPYMAPFDVFQAQDKPFVICCGNDHLFKALCDVIGAPELATDPRFVENHDRMANNDALKAALEKALSKQPAAHWLDVIHKAGVPVGPLLDVAEAANLPQTAARNMLIKSGGVMMPGNPVKISGYDDPHERPGAPKLDEQGAALRKEFAAPEAK

SEQ ID NO: 33 - protein, 381 aa, Escherichia coli
MTNNESKGPFEGLLVIDMTHVLNGPFGTQLLCNMGARVIKVEPPGHGDDTRTFGPYVDGQSLYYSFINHGKESVVLDLKNDHDKSIFINMLKQADVLAENFRPGTMEKLGFSWETLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFNTQDKPITICCGNDKLFSALCQALELTELVNDPRFSSNILRVQNQAILKQYIERTLKTQAAEVWLARIHEVGVPVAPLLSVAEAIKLPQTQARNMLIEAGGIMMPGNPIKISGCADPHVMPGAATLDQHGEQIRQEFSS

SEQ ID NO: 34 - protein, 376 aa, Saccharomyces cerevisiae
MSKGKVLLVLYEGGKHAEEQEKLLGCIENELGIRNFIEEQGYELVTTIDKDPEPTSTVDRELKDAEIVITTPFFPAYISRNRIAEAPNLKLCVTAGVGSDHVDLEAANERKITVTEVTGSNVVSVAEHVMATILVLIRNYNGGHQQAINGEWDIAGVAKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLDAQKRYAQGVKNILNSYFSKKFDYRPQDIIVQNGSYATRAYGQKK

SEQ ID NO: 35 - protein, 443 aa, Bifidobacterium animalis
MADKSTAPLAGIKVIDWTQVQSGPSCTQILAWLGAEVIKLEKVHGGDPTRNEMNDVDGSYSLYFLQLNANKKSITLDMKDPEGKKILTDLLKDADVFVENIGPGDVEKLGFGWDEVHKINPKLIMASLKGFNQGSRFEHVKAFEPVAQCAGGAASTTGWWEGDKNIPTQSGAALGDSNTGMHLTIAILTALLQRERTGEGVFVYQSMQNAVLNLCRIKLRDQLILDHLHQLSYYDCYPGYKFGKAIPRAANAEGGLVLGWCYRAKGWETDPNAYVYIVIQQSQKGFENFCNAMGFQDWLTDPKFSTPNARDEHKQEVYKRVEEYTMQYDKYTLTKELGAKGVPVGPVLDWNELENDPDLNEDGTLITIDQGDARGKFKTIGLPFTMSNYAPDYQRAPKLGENNEEILKSLGYTDEQIADLATKGVIGSNDGVKADLTAAPAQA

SEQ ID NO: 36 - protein, 404 aa, Cupriavidus oxalaticus
MPAQHTHATPAGPLDGIRVLDLTAVVLGPLATQVLADFGADVIKIEGPEGDLMRANGVSQHAGMSSIYLALNRNKRSVVLDLKIPEGAEALRALIAGADVLVHNMRVAAIERLGFGYEAVARINPRIVYCVATGFGQDGPHRDKPAFDDIIQAGCGLVALGAGNGERPEYVPSLIADKTTGLALANAVLAALLHRERHGVGQSVEVPMLETMAAFVMTEHLGGLTFEPAPAGAGYARLLQGGRRPAPTRDGWICALPYTERHWHAFFRAVGRDDLADRYEVGDRAQRNANIRALYGHLAELTPERSTAEWMALFEALDIPATPIYDLDALVDHPHLRAVGLFQATQHPTEGPLREVRPAARFSATPLSLRRHAPALGEHTAEVLQEAGIALPAAHAGTPAGAQE

SEQ ID NO: 37 - protein, 416 aa, Cupriavidus oxalaticus
MNLPLNGIKIIDFTHVQAGPACTQLLAWFGADVIKVERPGSGDVTRTQLRDIPDVDALYFTMLNSNKRSLTLDTKKPEGKKILEQLIRESDVLVENFGPGALDRMGFSWERINELNPKMIVASVKGFSDGHHYEDLKVYENVAQCAGGAASTTGFWDGPPTVSAAALGDSNTGMHLAIGILTALIGRDKTGKGQKVAVSMQDAVLNLCRVKLRDQQRLDRLGFLEEYPQYPHGSFSDVVPRGGNAGGGGQPGWVLKCKGWETDPNAYIYFTIQGHAWEPICKALGKPEWIDDPNYATAKARQPHIFDIFNTIEEWLADKTKYEAVDILRKHDIPCSPVLSMKEIAADPSLRASGSITEVPHKERGTYLTVGSPIKFSDLKPEITGSPLLGEHSEEVLAGLGYGTDDIKRLRESQVI

SEQ ID NO: 38 - protein, 416 aa, Escherichia coli
MSTPLQGIKVLDFTGVQSGPSCTQMLAWFGADVIKIERPGVGDVTRHQLRDIPDIDALYFTMLNSNKRSIELNTKTAEGKEVMEKLIREADILVENFHPGAIDHMGFTWEHIQEINPRLIFGSIKGFDECSPYVNVKAYENVAQAAGGAASTTGFWDGPPLVSAAALGDSNTGMHLLIGLLAALLHREKTGRGQRVTMSMQDAVLNLCRVKLRDQQRLDKLGYLEEYPQYPNGTFGDAVPRGGNAGGGGQPGWILKCKGWETDPNAYIYFTIQEQNWENTCKAIGKPEWITDPAYSTAHARQPHIFDIFAEIEKYTVTIDKHEAVAYLTQFDIPCAPVLSMKEISLDPSLRQSGSVVEVEQPLRGKYLTVGCPMKFSAFTPDIKAAPLLGEHTAAVLQELGYSDDEIAAMKQNHAI

SEQ ID NO: 39 - protein, 428 aa, Oxalobacter formigenes
MTKPLDGINVLDFTHVQAGPACTQMMGFLGANVIKIERRGSGDMTRGWLQDKPNVDSLYFTMFNCNKRSIELDMKTPEGKELLEQMIKKADVMVENFGPGALDRMGFTWEYIQELNPRVILASVKGYAEGHANEHLKVYENVAQCSGGAAATTGFWDGPPTVSGAALGDSNSGMHLMIGILAALEMRHKTGRGQKVAVAMQDAVLNLVRIKLRDQQRLERTGILAEYPQAQPNFAFDRDGNPLSFDNITSVPRGGNAGGGGQPGWMLKCKGWETDADSYVYFTIAANMWPQICDMIDKPEWKDDPAYNTFEGRVDKLMDIFSFIETKFADKDKFEVTEWAAQYGIPCGPVMSMKELAHDPSLQKVGTVVEVVDEIRGNHLTVGAPFKFSGFQPEITRAPLLGEHTDEVLKELGLDDAKIKELHAKQVV

SEQ ID NO: 40 - protein, 385 aa, Bacillus subtilis
MKKQNDIPQPIRGDKGATVKIPRNIERDRQNPDMLVPPETDHGTVSNMKFSFSDTHNRLEKGGYAREVTVRELPISENLASVNMRLKPGAIRELHWHKEAEWAYMIYGSARVTIVDEKGRSFIDDVGEGDLWYFPSGLPHSIQALEEGAEFLLVFDDGSFSENSTFQLTDWLAHTPKEVIAANFGVTKEEISNLPGKEKYIFENQLPGSLKDDIVEGPNGEVPYPFTYRLLEQEPIESEGGKVYIADSTNFKVSKTIASALVTVEPGAMRELHWHPNTHEWQYYISGKARMTVFASDGHARTFNYQAGDVGYVPFAMGHYVENIGDEPLVFLEIFKDDHYADVSLNQWLAMLPETFVQAHLDLGKDFTDVLSKEKHPVVKKKCSK

SEQ ID NO: 41 - protein, 202 aa, Hordeum vulgare
MSDPDPLQDFCVADLDGKAVSVNGHTCKPMSEAGDDFLFSSKLTKAGNTSTPNGSAVTELDVAEWPGTNTLGVSMNRVDFAPGGTNPPHIHPRATEIGMVMKGELLVGILGSLDSGNKLYSRVVRAGETFVIPRGLMHFQFNVGKTEAYMVVSFNSQNPGIVFVPLTLFGSDPPIPTPVLTKALRVEAGVVELLKSKFAGGS

SEQ ID NO: 42 - protein, 395 aa, Moorella thermoacetica
MGKVRNISGCVAVAHGVRLADVDVICSYPIRPYTGIMSELARMVADGELDAEFVHGEGEHAQLSVVYGASAAGARVFTGSSGVGVTYAMEVYSPISGERLPVQMAIADRTLDPPGDFGEEHTDAECCRDQGWIQGWASTPQEALDNTLIYYRVGEDQRVLLPQYACLDGYFVSHILGPVDIPDEAQVKEFLPPYKNHHVLDPRKPQIIGPQIEPAMGPPLQYQRYQAVKGVHKVLEEACDEFARIFGRKYDPYLDEYLTDDAEVIIFGQGAHMETAKAVARRLRNLGEKVGVARLRTFRPFPTEQIKERLSKFKAIGVLDVSANFGISCSGGVLLSELRAALYDYGDKVKTVGFVAGLGGEVVTHDEFYRMFQKLKEIAKTGKVEQTSYWIPFEL

SEQ ID NO: 43 - protein, 314 aa, Moorella thermoacetica
MMDRIASIKKAPDEEYYVPGHRTCAGCGPALTYRLVAKAAGPNTIFIGPTGCMYVANTSYGCGPWRVPWIHAQITNGGAVASGIEAAYKAMIRKKKTDAEFPNIIVMAGDGGAVDIGLQALSAMLYRGHDVLFICYDNESYANTGIQTSPTTPYGANTTFTPPGEVVPEGKKLFPKDNPKVIAHGHPELKYVATASIGWPVDLMNKVRKGLNQEGPAYIHIHAPCPKGWQFPADKTIEMAKLAVQTGMFQLYEYENGEYKLSVKVDKRKPVSEYMKLQKRFAHLKPEHIAKMQAFVDARCAEVGITVPVVASNA

SEQ ID NO: 44 - protein, 315 aa, Moorella thermoacetica
MSTKDLFAEPNLKQITVWARGVVMNKDARDIVVALTEAAAKEGKYVQAWENYVDLPDRIYVPVRAYARISSDPIESKYIYENETPDIVVLVEESLIKGVPILKGIRPGSTLVVNTKRSIDTILEFLGDTGNLAQIVTVDANSMAEAVMTLSGAEGATDATGIGAGIAAPIAGAVVKATGIVDVENLAAVVKNPAAMRRGYAEAQVRQLPPHEAVEEAAVSATELLRQMPFAGTVPSPVTENEGMVTGNWRIQRPIIDREACTECYTCWIYCPDSCITRTEEGPVFNMKYCKGCGLCTAVCPSGALTNVPELDFKD

SEQ ID NO: 45 - protein, 514 aa, Arabidopsis thaliana
MDSDTLSGLLENVAKKFPDRRALSVSGKFNLTHARLHDLIERAASRLVSDAGIKPGDVVALTFPNTVEFVIMFLAVIRARATAAPLNAAYTAEEFEFYLSDSDSKLLLTSKEGNAPAQEAASKLKISHVTATLLDAGSDLVLSVADSDSVVDSATELVNHPDDGALFLHTSGTTSRPKGVPLTQLNLASSVKNIKAVYKLTESDSTVIVLPLFHVHGLLAGLLSSLGAGAAVTLPAAGRFSATTFWPDMKKYNATWYTAVPTIHQIILDRHASHPETEYPKLRFIRSCSASLAPVILSRLEEAFGAPVLEAYAMTEATHLMSSNPLPEEGPHKPGSVGKPVGQEMAILNEKGEIQEPNNKGEVCIRGPNVTKGYKNNPEANKAGFEFGWFHTGDIGYFDTDGYLHLVGRIKELINRGGEKISPIEVDAVLLTHPDVSQGVAFGVPDEKYGEEINCAVIPREGTTVTEEDIKAFCKKNLAAFKVPKRVFITDNLPKTASGKIQRRIVAQHFLEKP

SEQ ID NO: 46 - protein, 528 aa, Methylobacterium extorquens
MTMLLPEPSALLPTDSKEASVPATTLHELIQAGADAAPALSSPGGVPLTFQALRALTERTVADLNARGIGRGDRVAIVLPNGPEMAAAFIAVAAGTTSAPLNPSYKADEFEFYMSDLGAKLLLVAEGSETPAVAVAEKLGVSVARLRPTPDEGAGSFTLHFASESTGPTEKSGPAGSDDIALVLHTSGTTSRPKIVPLTQANVCASARNIRTALAFGPEDRGLNIMPLFHIHGLIAGILAPLSVGGQVSCTPGFNALKFFGWMDEVNPTWYTGVPTMHQAILGRAARNKEIIARNPLRFIRSSSSSLPPQVMKELEETFGAPVIEAYGMTEAAHQMASNPLPPKPHYAGSVGLAAGPEIAVVDLDGEPLPAGETGEIVIRGDNVMKGYENNEKANAEAFTKQGWFRTGDQGVLSPEGYLSITGRLKEIINRGGEKISPREVDEILMDHPAVSQCVTFAVPHDKLGEDVAAAIVLREGVEAVEKDIRSFASERLAAFKVPAKILILDEIPKGATGKLQRIGLAQKLGLV

SEQ ID NO: 47 - protein, 543 aa, Saccharomyces cerevisiae
MTSAATVTASFNDTFSVSDNVAVIVPETDTQVTYRDLSHMVGHFQTMFTNPNSPLYGAVFRQDTVAISMRNGLEFIVAFLGATMDAKIGAPLNPNYKEKEFNFYLNDLKSKAICVPKGTTKLQSSEILKSASTFGCFIVELAFDATRFRVEYDIYSPEDNYKRVIYRSLNNAKFVNTNPVKFPGFARSSDVALILHTSGTTSTPKTVPLLHLNIVRSTLNIANTYKLTPLDRSYVVMPLFHVHGLIGVLLSTFRTQGSVVVPDGFHPKLFWDQFVKYNCNWFSCVPTISMIMLNMPKPNPFPHIRFIRSCSSALAPATFHKLEKEFNAPVLEAYAMTEASHQMTSNNLPPGKRKPGTVGQPQGVTVVILDDNDNVLPPGKVGEVSIRGENVTLGYANNPKANKENFTKRENYFRTGDQGYFDPEGFLVLTGRIKELINRGGEKISPIELDGIMLSHPKIDEAVAFGVPDDMYGQVVQAAIVLKKGEKMTYEELVNFLKKHLASFKIPTKVYFVDKLPKTATGKIQRRVIAETFAKSSRNKSKL

SEQ ID NO: 48 - protein, 367 aa, Bifidobacterium animalis
MTKILIDDIIPIIVIMALGYVCGKLSYFDNDQRQGLNKLVLNIALPAALFISIVKATREMLAQDAVLTILGFIGIIVMFMLSYYLCRLMFHHSIQEAAVCALIAGSPTIGFLGFAVLDPIYGDTVSTNLVIAIISIVVNAVTIPIGMYLINLGQSKDRERLSKAAVTNSKGQVSIANPKDDIAVDPNKDAKTDKTAEVMISKSSNMGKKKNQNLEALINALKQPVCWAPLLAIVLVLIGVRVPSGFAPTFDLIAKANSGVAVLAAGLALSTVKFSLGWETIWNTFYRLILTPAAFLGVGLLLGMGSNVNKLSMLVMAVALPPAFSGIIISSRYNIYVKEGASTTAVSTVAFAVTCLLWIWLVPLCCH

SEQ ID NO: 49 - protein, 440 aa, Cupriavidus oxalaticus
MSNATAGALSPNQGASESTRWIQLLVGVVCMIATANIQYAWTLFVPEIQDTYGWSRASIQIAFTVFVLVQTWLAPIEGYFIDKFGPRMMVAFGALFIGTAWVINSQATTLMGFYVGAAVGGLGVGSIYATCINNALKWFPDRRGLAVGLTAGGYGAGSAATILPIAAMIESQGFQHTFLFFGLLQGSLAFVAAWFLRSPKTGEVRGSKKLAQATRDYTLKEALCTRLFWLMLVMFVLVVTGGMMAVAQLGVIAKDLGVKEFQVDLHFFVMAALPLALMLDRIMNGISRPLFGWISDNIGREKTMVIAFTLEGLGIIALGYFGSNPYAFLILSGVVFLAWGEVYSLFSALAGDAFGTKHIGKIYGVLYTAKGIGALFVPIGNLLMEATGTWSTVLYTVAVMDLTAAFLAIMVLRPVLASHVATSRQRFAQESAAAGAQVAA

SEQ ID NO: 50 - protein, 439 aa, Cupriavidus oxalaticus
MELQQRESTSRFASPWVQLVFGVICMAMIANMQYGWTLFVNPIDDKYHWGRTAIQVAFTIFVVTETWLVPIEGYLVDKYGPRPVVVGGGLLCAIAWALNSVASSLPMLYFAAAIGGVGAGAVYGTCVGNALKWFPNRRGLAAGITAAGFGAGSAMTVVPIANMIKTSGYEATFLWFGLGQGLIVFILGLALYPPSARILSEVKTTLKAAATYNATPRQVLKSPIFWIMYAMFVMMAAGGLMATAQLGPIAKDFGLHDSPVSILGLTLPALTFALTIDRVLNGLTRPFFGWISDHIGRERTMFFAFAVEAVGILLLSKYGHNPVAFVVLTGIVFFAWGEIYSLFPATCGDTFGPKFAATNAGLLYTAKGTAALLVPFSSVITAATGDWHAVFMLASGMAALSAVLALFVLKPMREAHARKYVHANTAAPMGYRAVQEDLT

SEQ ID NO: 51 - protein, 402 aa, Escherichia coli
MTPSNYQRTRWLTLIGTIITQFALGSVYTWSLFNGALSAKLDAPVSQVAFSFGLLSLGLAISSSVAGKLQERFGVKRVTMASGILLGLGFFLTAHSDNLMMLWLSAGVLVGLADGAGYLLTLSNCVKWFPERKGLISAFAIGSYGLGSLGFKFIDTQLLETVGLEKTFVIWGAIALLMIVFGATLMKDAPKQEVKTSNGVVEKDYTLAESMRKPQYWMLAVMFLTACMSGLYVIGVAKDIAQSLAHLDVVSAANAVTVISIANLSGRLVLGILSDKIARIRVITIGQVISLVGMAALLFAPLNAVTFFAAIACVAFNFGGTITVFPSLVSEFFGLNNLAKNYGVIYLGFGIGSICGSIIASLFGGFYVTFYVIFALLILSLALSTTIRQPEQKMLREAHGSL

SEQ ID NO: 52 - protein, 418 aa, Oxalobacter formigenes
MNNPQTGQSTGLLGNRWFYLVLAVLLMCMISGVQYSWTLYANPVKDNLGVSLAAVQTAFTLSQVIQAGSQPGGGYFVDKFGPRIPLMFGGAMVLAGWTFMGMVDSVPALYALYTLAGAGVGIVYGIAMNTANRWFPDKRGLASGFTAAGYGLGVLPFLPLISSVLKVEGVGAAFMYTGLIMGILIILIAFVIRFPGQQGAKKQIVVTDKDFNSGEMLRTPQFWVLWTAFFSVNFGGLLLVANSVPYGRSLGLAAGVLTIGVSIQNLFNGGCRPFWGFVSDKIGRYKTMSVVFGINAVVLALFPTIAALGDVAFIAMLAIAFFTWGGSYALFPSTNSDIFGTAYSARNYGFFWAAKATASIFGGGLGAAIATNFGWNTAFLITAITSFIAFALATFVIPRMGRPVKKMVKLSPEEKAVH

SEQ ID NO: 53 - protein, 590 aa, Bifidobacterium animalis
MVDVSVTATSSDQNLTDSPHYLAETLIKNGVKHMYGVVGIPVTDFARIAQGMGIRFIGMRHEEDAVNAAAAEGFLTGRPAVALTVSAPGFLNGLAPLLEATTNGFPVIMIGGSSTRHVVDMHEGEYEGLDQMNYAKQFCKESFRIDKIEDIPLAVARAMHIACSGRPGGVYIDFPDDAVAQTLDKDVAESQLWVANQPAPAMPPAQSSVDEALKLLSEAKNPLMLVGKGAALAQAEDELREFVEKTDMPFQPMSMAKGVIPDDDPHCTASCRGLALRTADVVLLVGARLNWMLNFGEGKEWNPNVKFIQIDIDPNEIENARSIACPVVGDIKSAMQMINAGLEKTPVKASAQWLDMLKADAEKNDAKFAARVNSNTVPMGHYDALGAIKKVYDQHKDMILTNEGANTLDDCRNIIDIYQPRHRLDCGTWGVMGCAVGYSIGAAVATGKPVLYVGGDSGFGFDGMEVEVACRYNLPITFVVLNNGGIYRGDFENLGDDGDPSPLTLSYDAHYERMIEAFGGNGYYATTPAEVEQMVGEAVASGKPSLVHVQLADYAGKESGHISNLNPKPVVGPLATSEMTANPYLKGAHM

SEQ ID NO: 54 - protein, 579 aa, Cupriavidus oxalaticus
MAEVGNELQRHAAEEHQAQTDGFHLVIDALKLNGIENIYGLPGIPVTDLARLAQANGMRVISFRHEQNAGNAAAIAGFLTQKPGVCLTVSAPGFLNGLTALAHATTNCFPMILISGSSEREIVDLQQGDYEEMDQLAIARPHAKAAFRVLHAEDIGVGIARAIRAAVSGRPGGVYLDLPAKLLGQSMEAEKGRKSLIKVVDPAPRQLPAPDSVDRAVALLKSAKRPLILVGKGAAYARAEADIRTLVEKTGIPYLPMSMAKGLLPDTHPQSASAARSYVLAEADVVLLVGARLNWLLSHGKGKTWGKPKQFIQIDIAPTEMDSNVAIAAPVVGDIGSCVSAILDKVGDDFARPGADWLNAVADRRDTNLAKMAETLARSRDASPMNFHGALGVLKDVVKANPNISFVNEGANTLDYARAVIDMYEPRKRLDVGTWGVMGVGMGYAVAAAVETGKPVLALCGDSAFGFSGMEVETICRYNLPVCIVIFNNNGVYKGIDVNPTGGRDPAVTTFVPGARYDKMMEAFGGVGANVTTPAELEAAVNEALRSGKPTLVNAVIDPAAGTESGRLTNLNPQSSAKK

SEQ ID NO: 55 - protein, 564 aa, Escherichia coli
MSDQLQMTDGMHIIVEALKQNNIDTIYGVVGIPVTDMARHAQAEGIRYIGFRHEQSAGYAAAASGFLTQKPGICLTVSAPGFLNGLTALANATVNGFPMIMISGSSDRAIVDLQQGDYEELDQMNAAKPYAKAAFRVNQPQDLGIALARAIRVSVSGRPGGVYLDLPANVLAATMEKDEALTTIVKVENPSPALLPCPKSVTSAISLLAKAERPLIILGKGAAYSQADEQLREFIESAQIPFLPMSMAKGILEDTHPLSAAAARSFALANADVVMLVGARLNWLLAHGKKGWAADTQFIQLDIEPQEIDSNRPIAVPVVGDIASSMQGMLAELKQNTFTTPLVWRDILNIHKQQNAQKMHEKLSTDTQPLNYFNALSAVRDVLRENQDIYLVNEGANTLDNARNIIDMYKPRRRLDCGTWGVMGIGMGYAIGASVTSGSPVVAIEGDSAFGFSGMEIETICRYNLPVTIVIFNNGGIYRGDGVDLSGAGAPSPTDLLHHARYDKLMDAFRGVGYNVTTTDELRHALTTGIQSRKPTIINVVIDPAAGTESGHITKLNPKQVAGN

SEQ ID NO: 56 - protein, 568 aa, Oxalobacter formigenes
MSNDDNVELTDGFHVLIDALKMNDIDTMYGVVGIPITNLARMWQDDGQRFYSFRHEQHAGYAASIAGYIEGKPGVCLTVSAPGFLNGVTSLAHATTNCFPMILLSGSSEREIVDLQQGDYEEMDQMNVARPHCKASFRINSIKDIPIGIARAVRTAVSGRPGGVYVDLPAKLFGQTISVEEANKLLFKPIDPAPAQIPAEDAIARAADLIKNAKRPVIMLGKGAAYAQCDDEIRALVEETGIPFLPMGMAKGLLPDNHPQSAAATRAFALAQCDVCVLIGARLNWLMQHGKGKTWGDELKKYVQIDIQANEMDSNQPIAAPVVGDIKSAVSLLRKALKGAPKADAEWTGALKAKVDGNKAKLAGKMTAETPSGMMNYSNSLGVVRDFMLANPDISLVNEGANALDNTRMIVDMLKPRKRLDSGTWGVMGIGMGYCVAAAAVTGKPVIAVEGDSAFGFSGMELETICRYNLPVTVIIMNNGGIYKGNEADPQPGVISCTRLTRGRYDMMMEAFGGKGYVANTPAELKAALEEAVASGKPCLINAMIDPDAGVESGRIKSLNVVSKVGKK

SEQ ID NO: 57 - protein, 560 aa, Saccharomyces cerevisiae
MTTTATQHFAQLLQKYGIDTVFGIVGIPIVQLADTMVANGIKFIPCRNEQAASYAASAYGYISDKPGVLLIVGGPGLIHALAGIYNSMSNRWPLLVIAGSSSQSDIHKGGFQELDQVSLLSPFLKFTGKLTPDNIDMITQKALNYCIQGTAGVSYIDVPADFIEYEKPLEGNDRTGNELPMILTPNICGPDPSKIKKVVQLILQHKNKNILIVIGKGAVKNSHEIRRLVNTFNLPFLPTPMAKGIVPDSSPLNVSSARSQALKIADIVLVLGARLNWILHFGTSPKWNSESIFIQFDSNPETLGDNNVSPGADLSIWGDIGLSVTALVEELTRQDSCWKYSGVKQEIREKIQLNQTRLLRKEKTRGAQLNYNQVYGTLRPLIDDYRTILVTEGANTMDIARISFPTDAPRRRLDAGTNATMGIGLGYALACKASHPELDVVLIQGDSAFGFSAMEIETAVRCQLALVIVVMNNSGIYHGEKDIEGDLPPTALSKNCRYDLVGKGLGANDFFVNTISELSRCFQQAVQLSRTKRETSVINVIIEPGEQKQIAFAWQNKPRL

SEQ ID NO: 58 - protein, 335 aa, Methylobacterium extorquens
MSIAIVGAGAIGGYLGVRLAEAGEDVTFIARSNAAAIQADGMRLIEEDGTEIHSKSVKATRSMQEAGVHEVVLLTVKAHQVGPIAADLHHLIGPDTVVVTMQNGIPWWYFLGGYSGDHAGTRLESADPGGLIADHLDPKHVIGSVVYPATVLTDPGTVKVIEGNRFGLGELDGSKSERVLALSQRLARAGFRAPVTSDIRAEIWLKLWGNLSFNPISALTHATLEDICRFPDTRAIAAEMMREAEVIANKLGVTFRLGIDKRIAGAEKVGPHKTSMLQDVEAGRPIELEALVGSVIELGRLTGTPTPHIDTVFALMRLLAQSLERAQGRLAIQGA

SEQ ID NO: 59 - protein, 398 aa, Cupriavidus oxalaticus
MTQSNLPDLPDLPLTGLRVIDFSRVLAGPYCTALLGDLGAEVIKVEPPGGDDYRAVGPFAGGKSGLFCAMNRNKQSIVIDLKTEDGLAVARALCRGADVVVENFRPGVADKLGIGYAALRELNPSLVYASVSGFGQTGPESHRPAYDIILQAMCGLMDATGAPDGAPTMLGEAVSDAVSGLFASWGVLAALLAREKTGRGTHVDVSMFDATLSLSATLVARYAATGLAPRRVGNRHPSSAPFGAYRAADGFYVVAVLNNKLFQALADAIGRPAMAHDPRFADDETRCRFESDLRAMLENWSATRTVAEVNAALGAAGIPVAPIRNVKEALESEHAAHRRLLTEVPDTDGGTVRLPSQPVKFSAYGTNRVTPAPALGQHTGAILAAPDFSNFNKEKQHA

SEQ ID NO: 60 - protein, 406 aa, Cupriavidus oxalaticus
MGALSHLRVLDLTRVLAGPWCAQNLADFGADVIKIERPGAGDDTRTWGPPWLKDEDGRDTAEAAYYLAANRNKRSVTCDISTPEGQQIVRDLAAQSDVVLENYKVGQLKKYGLDYESLRQVKPDLIYCSVTGFGQTGPYAARPGYDFIIQGMGGFMSLTGERDDLPGGGPQKAGVAISDLMTGQYATIAVLAALAHRERTGEGQYIDMALLDVQVAMLANMNTNYLASGEAPRRWGNAHPNIVPYQTFQAADGWIIVAVGNDGQFRKFVTDGGMPELADDPRFAKNPQRVANRDVLVPILAEMVRPRTRAQWIRDLEAAGVPCGPINTLDDVFEDDQVKARGLRVDLPHPSAGEVKLVASPIKMSATPPQALRHPPLLGEHTDTVLAETLGYSAGQIAALRAKGVL

SEQ ID NO: 61 - protein, 505 aa, Cupriavidus oxalaticus
MDKERIRLARLHDKVVSADEAAALIRDGMTVGMSGFTRAGDCKEVPFALARRAATEPLRITLMTGASLGNDIDRVLAEADVIARRLPFQSDGTLRRKINAGEVMFIDQHLSETVEQLRSGQIAPVDVAVVEAVAITEQGGIIPSTSVGNSASFAMLARKVIVEINMNMPLELEGLHDIYFPVQRPYRQPIPLIAPEQRIGLPYIPIDPEKIAAIVITAKDDSPSNALPPDDETRSIAGHLNDFLLREVRAGKLSPSLQPLQAGIGTIANAVLHGLVESPFRDLKMYSEVLQDSTIELLDAGRLSFASASSVTLTREVYQRFLSNLDRYRSRLLLRPQEISNHPEILRRLGLITINTALECDIYGNVNSTHVGGTHMMNGIGGSGDFARNAHVSVFVTKSVAKGGEVSSIVPMVAHVDHTEHDVDIIVTEHGLADLRGLAPRERARTVIANCADPQYRELLGDYFRRASAHGGQTPHLLEEALSWHVGLRDRGTMRSAQPAQALAA

SEQ ID NO: 62 - protein, 403 aa, Cupriavidus oxalaticus
MVNEANKEKMPLQGVRVLELGSLIAGPYAGGLLAQFGAEVLKIEAPGEGDPLRKWRKLYEGTSLWWYSQSRNKKSLTLDLRSAQGQDIVRKLVAGADIVIENFRPGTLEKWGLGWEDLRKVNPALVMVRISGYGQTGPYKDRPGFAAIAESMGGLRYVSGYPDRPPVRSGVSIGDTLASLYGVIGALLAMHHLRNNDGEGQFVDVALYESVFAVMESLVPEFDKFGHVRERSGASLPGISPSNTYPCQDGQYVIIAGNGDAIFRRFMTAIGRDDLGQDPRLAHNDGRVQHNAMLDDAIAAWTAAHDLDTVLATLEAAAVPCGRIYTAQDICSDPHYSARGMIEPHQLPDGSPLALSGIVPRLSETPGRTNWIGPALGEHTEEILAGIGIAGAEFRALREAGVV

SEQ ID NO: 63 - DNA, 10262 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 64 - DNA, 12403 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctgagctgtcaccggatgtgctttccggtctgatgagtccgtgaggacgaaacagcctctacaaataattttgtttaatccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcaggttcaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactgcccgacgaacggactaatcctgacgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 65 - DNA, 9922 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgcgttcctggcgtggtgctcgcatagtagactagagatctatgtgaggatcctaactcgagatcgagactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagttatatacattcatgtccatttatgtaaaaaatcctgctgaccttgtttatgtcttgtcagtcaccatttgcaaaaccatatttgaccctcaaagaggctgaatttgataagcaacttgctacatactcataataaggagctaaatagaacacgaatgggaaatactcaaatgccaaactaaagaagatattggccaaaataaacgctataccgagagagaaacttgatttttcaacttcctaaaacagtgttgttcaaacatttctacttatttgtacttaccagttgaacctacgtttccctaataaaatgtctatggtaaaaagttaaaaaatcctcctacttttgttagatatatttttttgtgtaattttgtaatcgttatgcggcagtaataatatacatattaatacgagttaggaatcctgtagttctcatatgctacgaggaggtattaaaaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggctgtgtggataatggtgacaccataacggactctatggatatagagaaacgtagaggaattactgttcgggcttctacgacatctattatctggaatggtgtgaaatgcaatatcattgacactccgggacacatggattttattgcggaagtggagcggacattcaaaatgcttgatggagcagtcctcatcttatccgcaaaggaaggcatacaagcgcagacaaagttgctgttcaatactttacagaagctgcaaatcccgacaattatatttatcaataagattgaccgagccggtgtgaatttggagcgtttgtatctggatataaaagcaaatctgtctcaagatgtcctgtttatgcaaaatgttgtcgatggatcggtttatccggtttgctcccaaacatatataaaggaagaatacaaagaatttgtatgcaaccatgacgacaatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatcacttcttttatacttcctccggcatcggtttcaaacagactttcatcttatctttataagatagagcatgaccccaaaggacataaaagaagttttctaaaaataattgacggaagtctgagacttcgagatgttgtaagaatcaacgattcggaaaaattcatcaagattaaaaatctaaaaactatcaatcagggcagagagataaatgttgatgaagtgggcgccaatgatatcgcgattgtagaggatatggatgattttcgaatcggaaattatttaggtgctgaaccttgtttgattcaaggattatcgcatcagcatcccgctctcaaatcctccgtccggccagacaggcccgaagagagaagcaaggtgatatccgctctgaatacattgtggattgaagatccgtctttgtccttttccataaactcatatagtgatgaattggaaatctcgttatatggtttaacccaaaaggaaatcatacagacattgctggaagaacgattttccgtaaaggtccattttgatgagatcaagactatatacaaagaacgacctgtaaaaaaggtcaataagattattcagatcgaagtgccgcccaacccttattgggccacaatagggctgactcttgaacccttaccgttagggacagggttgcaaatcgaaagtgacatctcctatggttatctgaaccattcttttcaaaatgccgtttttgaagggattcgtatgtcttgccaatccgggttacatggatgggaagtgactgatctgaaagtaacttttactcaagccgagtattatagcccggtaagtacaccagctgatttcagacagctgaccccttatgtctttaggctggccttgcaacagtcaggtgtggacattctcgaaccgatgctctattttgagttgcagataccccaagcggcaagttccaaagctattacagatttgcaaaaaatgatgtctgagattgaagatatcagttgcaataatgagtggtgtcatattaaagggaaagttccattaaatacaagtaaagactatgcatcagaagtaagttcatacactaagggcttaggcatttttatggttaagccatgcgggtatcaaataacaaaaggcggttattctgataatatccgcatgaacgaaaaagataaacttttattcatgttccaaaaatcaatgtcatcaaaataaccacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 66 - DNA, 7500 bp, Artificial Sequence
  Description of Artificial Sequence: Synthetic polynucleotide
gataaaacgaaaggctcagtcgaaagactgggcctttcgttttacaattgggctaccttttttttgttttgtttgcaatggttaatctattgttgaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgacttgagaccggctattacgagcgcttaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagttatatacattcatgtccatttatgtaaaaaatcctgctgaccttgtttatgtcttgtcagtcaccatttgcaaaaccatatttgaccctcaaagaggctgaatttgataagcaacttgctacatactcataataaggagctaaatagaacacgaatgggaaatactcaaatgccaaactaaagaagatattggccaaaataaacgctataccgagagagaaacttgatttttcaacttcctaaaacagtgttgttcaaacatttctacttatttgtacttaccagttgaacctacgtttccctaataaaatgtctatggtaaaaagttaaaaaatcctcctacttttgttagatatatttttttgtgtaattttgtaatcgttatgcggcagtaataatatacatattaatacgagttaggaatcctgtagttctcatatgctacgaggaggtattaaaaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggctgtgtggataatggtgacaccataacggactctatggatatagagaaacgtagaggaattactgttcgggcttctacgacatctattatctggaatggtgtgaaatgcaatatcattgacactccgggacacatggattttattgcggaagtggagcggacattcaaaatgcttgatggagcagtcctcatcttatccgcaaaggaaggcatacaagcgcagacaaagttgctgttcaatactttacagaagctgcaaatcccgacaattatatttatcaataagattgaccgagccggtgtgaatttggagcgtttgtatctggatataaaagcaaatctgtctcaagatgtcctgtttatgcaaaatgttgtcgatggatcggtttatccggtttgctcccaaacatatataaaggaagaatacaaagaatttgtatgcaaccatgacgacaatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatcacttcttttatacttcctccggcatcggtttcaaacagactttcatcttatctttataagatagagcatgaccccaaaggacataaaagaagttttctaaaaataattgacggaagtctgagacttcgagatgttgtaagaatcaacgattcggaaaaattcatcaagattaaaaatctaaaaactatcaatcagggcagagagataaatgttgatgaagtgggcgccaatgatatcgcgattgtagaggatatggatgattttcgaatcggaaattatttaggtgctgaaccttgtttgattcaaggattatcgcatcagcatcccgctctcaaatcctccgtccggccagacaggcccgaagagagaagcaaggtgatatccgctctgaatacattgtggattgaagatccgtctttgtccttttccataaactcatatagtgatgaattggaaatctcgttatatggtttaacccaaaaggaaatcatacagacattgctggaagaacgattttccgtaaaggtccattttgatgagatcaagactatatacaaagaacgacctgtaaaaaaggtcaataagattattcagatcgaagtgccgcccaacccttattgggccacaatagggctgactcttgaacccttaccgttagggacagggttgcaaatcgaaagtgacatctcctatggttatctgaaccattcttttcaaaatgccgtttttgaagggattcgtatgtcttgccaatccgggttacatggatgggaagtgactgatctgaaagtaacttttactcaagccgagtattatagcccggtaagtacaccagctgatttcagacagctgaccccttatgtctttaggctggccttgcaacagtcaggtgtggacattctcgaaccgatgctctattttgagttgcagataccccaagcggcaagttccaaagctattacagatttgcaaaaaatgatgtctgagattgaagatatcagttgcaataatgagtggtgtcatattaaagggaaagttccattaaatacaagtaaagactatgcatcagaagtaagttcatacactaagggcttaggcatttttatggttaagccatgcgggtatcaaataacaaaaggcggttattctgataatatccgcatgaacgaaaaagataaacttttattcatgttccaaaaatcaatgtcatcaaaataaccacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaacgtaccggtctcagtagggagagctgtatgtgggtag

SEQ ID NO: 67 - DNA, 16251 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctgagctgtcaccggatgtgctttccggtctgatgagtccgtgaggacgaaacagcctctacaaataattttgtttaatccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcaggttcaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactgcccgacgaacggactaatcctgacgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgctctgggtctgacggccatcaagggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctagctgattagaaggccatcctgacggatggccttttttttgactgggtgttccgatacactcaatttgtgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctagctgattagaaggccatcctgacggatggccttttttttgacttagtttcaattttacattccaggaagtagactagagatctatgtgaggatcctaactcgagatcgagactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 68 - DNA, 164 bp, Artificial Sequence
  Description of Artificial Sequence: Synthetic polynucleotide
gataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtag

SEQ ID NO: 69 - DNA, 164 bp, Artificial Sequence
  Description of Artificial Sequence: Synthetic polynucleotide
gataaaacgaaaggctcagtcgaaagactgggcctttcgttttacaattgggctaccttttttttgttttgtttgcaatggttaatctattgttgaaatttaaagtttcacttgaactttcaaataatgttcttatatttgcagtgtcgaaagaaacaaagtag

SEQ ID NO: 70 - DNA, 63 bp, Artificial Sequence
  Description of Artificial Sequence: Synthetic oligonucleotide
  modified_base (6)..(12): a, c, t, g, unknown or other
  misc_feature (6)..(12): This region  may encompass 4-7 nucleotides
  modified_base (18)..(55): a, c, t, g, unknown or other
  misc_feature (18)..(55): This region may encompass 34-38 nucleotides
  modified_base (58)..(59): a, c, t, g, unknown or other
gttaannnnnnngttaannnnnnnnnnnnnnnnnnnnnnnnnnnnnnnnnnnnnntanntttg

SEQ ID NO: 71 - DNA, 62 bp, Artificial Sequence
  Description of Artificial Sequence: Synthetic oligonucleotide
  modified_base (6)..(12): a, c, t, g, unknown or other
  modified_base (18)..(54): a, c, t, g, unknown or other
  modified_base (57)..(58): a, c, t, g, unknown or other
gttaannnnnnngttaannnnnnnnnnnnnnnnnnnnnnnnnnnnnnnnnnnnntanntttg

SEQ ID NO: 72 - DNA, 78665 bp, Bacteroides ovatus
taaggattgattcgctagctcagcaggtagagcacaacacttttaatgttggggtcctgggttcgagccccaggcggatcactgaaacaaaaagcaaaacaatgaaaaccgctgataatcaatcattatcagcggtttttctttttatccatactgcaaattgaagcagaataccgcattttactggaggtgaaataggtggacttaatttccacataaaaacaagtccacctgattggattatatttcactgattctctgcgttttgcataaaacaaactcttttcaaaacatgtatttttacaccatcaaaaaaagaagagtatggcaatgcaaagaaactattttacggtattgtttttcctgaagaaatcaaagctgcttaaaaatggagaagcaccaatctgtatgcgtatcacaataaacggaaaacgtgcagaggtacaaatcaagcgaagtatagatgttacaaaatggaatacgcaaaaagaatgcgcgattggcagggaaaagaagtatcaagaaataaaccactatcttgatacgataagaactaaaatccttcaaattcaccgtgaacttgagcaggacggtaaacctattacagcagatattataaaaaatatctattatggagaacactctactcccaaaatgctgcttgaagtattccaggaacacaattcggaatatcgggaattaatgaacaaggaatatgccgaaggtactgtacttcgatacgaacgtacagcaagatatttgaaggagtttatcagtgaacaatataaactggctgatattccattaaaatcaatcaactatgaatttataaccaaattcgaacatttcattaaaatacagaaaaactgtgcgcaaaatgcgacagtgaaatatctgaaaaatttaaagaaaatcatcaaaactgcattgataaagaagtggataactgatgatccgtttgcagaaatacacttcaaacagaccaagtgtaaccgtgaattcttaaacgaaatggaacttcgcaaaatcatcaataaagattttgatattcaacgattacaaaccgtaagggacatattcatcttctgttgtttcaccggtttggctttcacagacgtaaagaatctgaaaaaggaacaccttgtacaggctgataatggtgaatggtggataagaaaagcaagggaaaagaccgataatatgtgcgacattccattgttggatataccaagacttattttagagaaatatcagtcaaatccaatctgcaatgaaaaaggattattacttcctgttcccagcaaccaacgaatgaacagttatttgaaagaaatagctgatgtatgtggtattcagaagaatctttccacacatattgcaagacatacatttgcatcactggctattgcaaataaggtttccttggaatccattgccaaaatgttaggacacacggacattcgtacaactcgtatttatgccaaaataatgaattctaccattgccaatgaaatgaaagtactgcaaaacaagttcgcaatataattttcaaccattatttcatttcttacagcaaatatcgcactttgccactgactgtgcaaggcggccctgtcgggctggttggcggaaaaaaatcatcctcgcttcgctccggtatttttttccgccaagccttgcaccggtcattggcaaagaacagccgggccagtaagaaattgaaatactggctccacggagccggtcatgtctaatttaaataaaagaatatgactgaagaagttggaaagaaggtatgtgaaggtacagtagcagacctcatgaaggacaagaccggaaaacagacggttgtcacgttgacaagaaagaatgcttaccgagtgaagaaaatcagagaacaagggacggatgacgaagctgtcctttttcatttccgtgaacgctgtacgggaatgggctcctatgtacacacaatcgaagcggcagacggagaaacagaacttcatccgtctgaatttgaaaaatgggaagctgtggaattcctgtatcccggctatctggaagacctgcttgatgctgcatacaacgcatacagatggagttccttcgaacctgaagcaagggcggaaacagacatcatgcaatatgaaaaacaacttgtagaggatctgaaacagattccggaagaaaaacagaacgagtataccagtgcataccatagcaagttctctgccttgctgggctgtctctcacgatgtgccagtccgatggtgacagggcctgccaaattcaactgccagcgcaacaacaaagccttggatgcataccagaacagatttgatgaatttcatgattggcgtaaccgcttcaaggctgccatggaaaggatgaaagaggctgccaaaccggaagaacagaagcaagaggaggcatggaaccgcctgaagcgtgacattgcaagcagcgcacagaccattcatgatattgataccggtaaagcaagaggatacagccgtgccttgtttgtcagcagtatccttaataaagtaagcacctatgcaggaaaaggagaagtggaaatcgtacagaaagcggtggacttcattacagacttcaatgcacaatgcaaaaaaccggttatcactccgcggaaccgtttcttccaactgccggaaatggcacgccaggccagactgaaacttcaggaaatcagagaacgggaaaaccgtgaactgaaatttgaaggcggaacgctggtatggaactatgaggcagaccgcctgcaaatccagtttgacaatattccggatgaccagaggcgcaaggaactgaaatcatacggtttcaaatggtcgccgagataccaggcatggcaacggcaacttacacagaatgccgtatatgcagtcaaaagagtgttgaaccttcaaaacctataagacatgaaagaccgattgaaatatgtaatcgattcccgctacttcgacggaacatgcctgacaagtatgagtgacggattccataatgactatggtggggaaacaatcgaagaactgcgcatacgggaaaacaatccctatctgaaagcagtaacaccttctgatatagacaagaagctgcggctatacaatcagtccctgtccgaaccgttcaaggaaatcactgaagaagaatactatgacctgctggatgtactgccacccttgcgcatgagacaaaactcgttctttgtaggagaaccgtattacggaaatatgtactctttctgctttactcgtcaaggaagatatttcaagggcctacgctccgtacttactccgcaatccgaactggacagtcagatagaccgtcacatggaaatcatcaaccggaaagccgtgatctcaaaagaggaaacaagtaaaacggtcacaaccggaaccagactcattccctattatttttcactggacggaaaacagcccgtattcatctgcaaccttgtcatccaatcagattccagtcaagcaaggacggacatggcgaataccctgaaaagtcttcgccggaaccattatcagttctataaaggaaaagggcattacgaaactccggacgaactgatagaccatgtatcaggaaagaagctcacccttgtttccgacggacatttctttcaatatcctcccggcagggaatccgcaactttcatcggacacatcaaggagacatcagaggaatttcttttccggatctatgaccgtgaatatttcctgtatcttcttaaaagactgaggaccgtgaaaaaggaatcggcacaggaacaaataaatatcaaatcataacattcgggggaatgcggtaaaatgactgccgtattccctcataaaaacaatacaagtatgaacaaatcaaacactctatactggaaaacagccacagatccggctgaacgcattgaggtcagactcgtcctgaacagttatatcgacaatgacaatctgtatgtaggacttgaatcccggtctaaggagaatccggaatgctgggaatcctacacggacatcaccgtcaacctcaattctcttcccccgttccatgcctatgtggacaaccgggactgcaacagacatgtgcatgattttctgaccagtaacagaatagcagaacctgccggatttgaatatcagggattcagaatgttccgcttcaatcctgacaggttgaaggaactcgcacccgaacagttcaagacaatcagcgccaaactgccaccacaggatgacatgataaaggacatcatctatcaggaaagacgtttccctttgagaactgttcaagacattcacggaatatatcttgtttcaagcaaggaactggaagaatctctgatcgaaggagtacggaacctggatgctgcggcatatgaactgctggatggcatctgcctgttctgctccacacaggaactgcgctatcttacggatgcagaactgatagaaacaatctacgcacaataaaaaggaggaacaaatatgaaaaccggagacattgtatttctgagacgtccctataagggataccgtgccgtcgaactgatggaaagactggaatgccgctggctggtcaggattgtcgagagcggtcttgaactggaggtatatgaagatgaacttatatcagaattttaatacagacaaagtgttatggaaaaatatcagtttgcattccattcggaaataatcggctatacctctcctcatatcggtgaggtcagaaaagccatacacagaaaagtggaaaaggaaaagtctgccgccataaagaatgatattgagctgcacatgtacaaagtgcatgacggcataccggttctccttaacacctgctacctgtacgatgaaaaaggatgtatggtacacggaagtatcaagggaaccaaggattatctgcttgagacatggagataccatacaaacagacattctaaaggcatcagttccacaagaatcaggccttgcacgacaagcagggctttttcatttgtataactcttaaaatcagaaatcatgaaccagacattacaacttacagactatattccacagaatgtaagcctctactacgtggactaccgggatgatcttgatgagcatgaagacatccaggaggaatgcatccgttccaacaaaatggaaaaactctatgaaaaggcatacgaatggtatgaggaacaggaaagttcaaacatgcacgactatctggaggagacaagaaagaatatggaaacggacaatttagccggagagtttgaagagcatgaagatgaaatcagggaacttatctacgaccggaacgattccgacccggtaaaggatatgatacgcaactcgtccgtcactaatttcttctattcgctcggagtggaaatcagcggatatctgaccggttgttcactgcggggagaatcagtcgccatggcctgccataaggtacgtcgcgcactgcatctgaaaaaggggcagtttgacgagaagattgaagaactggtagagaatgccacatacggtggagaactgcgcatctacttcaacgccatgtttgacaggctcatcagcaaaggccctgagaacgatttcaagagcatccgtttccacgggaatgtagtggtggtcattgccgacagccggaacggttccggacatcatgtacggattccgctggacatcactttccctttccgaagggagaacctgtttgtcgattcacaggtacactattcctatgccaatgaagtctgcggcatgaccaatgactggtgtgattccacaaaatgggaaacaggcatgataccttttaccggatctgtccgaaaaagccggatggctgaatacaagaaacaggaagccgcttatgagcagacattccgagacgggaaatgcaccttcggtgacatgaactacaaacgccaccgtgacgtgcggtattcgaatgaatatcctgccggatgcaggtgccctcattgcggtacattctggattgactgaaaaaacatttaccaaccaataaattcaaacgatatgaaaatctgctgttcacaagagcattacgacaaggtcgtacagtatgcaaaatcaatcaatgacaagacactggaaaactgtcttgaacgtctaaaacaatgggagaagaacgagaaccgtccatgcgaaatcgaactctattacgatcatgcgccgtattcgttcggattctgcgaacgttatccggacggaaatacaggcattgtcggaggactgctgtatcatggaaatccggacgaatcctttgccgtcaccatggaacgtttccacggatggagcatacatacctgacatatatgcgacagtctgtattggggagcctcatgcaatatggggttccctttttttatgccgcagacatgatgacagcatcctcatttcttgctgcaaaaatagctgtttgccgcgcaactcccgcaaggcggccctgccgggctggttgtctggaaaaaaatcatcctcgcttcgctccggtatttttttccgccaagccttgcagggatgcgggcaaacagacaacagggacaacaagaaataagaatgcctgtaccttacaggcagacaatgtataacaataaatatcagaagtcatgattacagaccagaagacacagaacaggcttcacgcggataccggaacggaactgttctccatcagacaaaggaaggaagccgtcacaaggatgctggacattctgaaagagactccggaatacctgcaggttatgaaccatataccggcttatgccatggatgacgatacgtcagaatggtggaaatcggaagaatcggaaaatttcatgaactcactcctggaagtgatggaaagctatactccggacggatacaggttcggaccgaaatccggcacgactgacctttacggctactgggaaagcaagaccgggcggacaaccctcttccatctgcttttcagtctggaaagcggatatgaatggggaaaaggtctttcccatgagaaaacggacgcattctacaaggaaataaaagagaaatttcatggagaaggattcgacacggacagaaccggctgtacatcacaggccatgtatcttgtaaaaggaaaaacacgcctgtacgtgcatccgatggaaataagcggctactgtgaaacactgcatattccacagattacagccatactgaaaaaaggaggccgtacattccgtcttgtaaaggatacgatagcggaagaggtgtattccttcaccgatgaagaagaactggaatattaccgtgccagatacggaacgtgcatccaccggaatatactggatgccttcagcaaccgccacgcagggaaagaggacatactttccatgatggcatcacggataaatgtggctacgacatcacatctttacggtatcggatatgattcgcctgcatacaggtttgtgcatgaggcatacgacagactggtaaacaatggaaagctgaaggagaatgtccgggaaatcggttgctgcaacatcataatggccatttcaaataccaacgcaatatgagactgaattacaatgacatgctgcttctggcaatatgggaatacaacaggagacaggacgaggatctgaccctggaactgtttcaggaaacattcggacaggttcccggcgcacatttccatgacaaatgggtgcattattacaacaagaacctgctgatgatggccgcctatttcaggggtgaggaagaaaacggccagaaattctgtgatatgatcacccgacaggttgaacgctatacacaaaacaggaggagaacaggatgaatacaaagatacgatatgaccttgacagtcttgaactggcaaacggtgacttcgggtatcccattacagaaaaggaagtacggaaagtgaaccgtatgctggaactgatggagaatgtccgaagcaggcagatgtgcccgacagaaggagactgcgtggaatttgtctcacgttctggtgactatttcggaaaagctcatatagaacggataacaggaaaatatgcggatatatgcctgataccggaaacggtattctgttttgatgacatgggaaaagccgcctatgataccaccggaagtccctggacgcaggtcaatatccggaacatgaaacccgcaggttctgaaatccgcatattcagaacatggggattcgggaagcgcagcaatacgggcagtctcaggttcgatgctccggtcaggaaatgggaatacagagaaccgaatccgttatatgacggttacaccacccgtaactggttccgctatcatatcatgaaacaccgggacagggaaaggacaggcgaatacaccttccgcagcgattcattcacgctgtacagccggagcgagctggacgagctggccgcaatcctgaaaggcagactctacaagggaatcctgcctgactctcttgtactttggggataccgcatggatattaaggaaatatcacgtgaacagtggaacggtatgggacagcacggacaaatccgcatgaaattcatgggatacggtccggtcagaatccacacggacaatgaaaaccataccgtaacagtatacagaatcaacgacatattgtcttcaactatcagaattttcatattttttcagttctttttttgtttcttctattaatattttaagccactccatgatttgtattgcatgttcatgaacagtttcattttggctatcactgtcgtgtagtagcctttgaaaatcacgtaaaatattgtctttcccaagcatctcccatacaggcatcatccggtggattatttttctcatggtctcacggtcggttatcctgtcagcagattccatctcctccagttctttttcagattccataacaacgagagaaagcatatgactataatcatccgtattctccagtaaactggaaaaatcgaattctccggaaactgaaacttgtgtacgagatataatggtggataaaaaagcaagcagtccgtggatattgaacggtttatgaatacagcctacaaatccttctttttcataaattccggaatttccgtcaccacgggcagtcatgactgctactggaacagttctagaattgccgatgtccgaattgcgaagcaatcttaacaaaccgaatccgtcagtatcaggcatttgtacatctgtcaagatcaaatcatattcagaattttcaagagcggccactacttcacgtgcattcttacaggttttacaggatatacctttgcgcccgagcatatcttccgctattttcagttgtataggatcatcgtccactacaagaacattcttaggcaatatagttattgtattatggtccgatttgtcttcctcaactaactcatccgtttcaggcaaagaaagttccagtctgaacatgcttcctttaccgagtacactttctacatccatttttccttccaaaaccttaattaatcctttggtaaggaaaagtcccaaaccaaacccttcagaattgacattctgtgcggcacgctcaaatggagcaaatattcttttcagtgtttcctcatccataccgataccagtatcccttatttcaatacgaagttttccttctgaatattctgaatggaaattgacgttacccctggaagtaaacttaatagcgtttgtaagtagattggctaaaacctgttcaagtttgtccgcatcaccttttactattacatttgatcctttatgttcagaatataaaatcagaccttttgaagtcgctttacgagaaaactcatctgaaattcgttgcaagaaacggtcaagataaaatggtgtgtcgttacgcaaattaccggcttcattgattcggtaagcatccatcaaatcattaaccagatgtaaaacgtgtcgacaagaatgacggatgtcatctaaatatttttcgcgcttcctcttttcacgcgtttcagataccaaatctgcacagttatggatattaccaagtggacctctaatatcatgagaaactgtcaggatgattttcttacgcatatcaagcaaattctcgttttcttgaatagcttgttgtaatttaaatttaattatttcttccttacgtaaatctgattgtataattaaaaatgaaattaatattataaaaaccgcaatactcatcattacgataaataatcgaaaggattcttgtttgacttccgttacctctaagtttcgttctataaatgacagctgtacctgattatctaaaaaagatacaaaatcatataatttttgatttaacagcctattctgcaaacgcaagctatccacataagtttctatctgattgtttcgcatatctatgacagaaaccaatctattattaaaattctgtatttcattagttatataggggacttgtatcgtctccttctttccgaataatccggcaattcctttctttttctgagttattgtcttcacttttactgtttgagtagctattacaggcaattcattagtaagaatactatcagatttattcgcaaattggactgctttcattatttgaaacaagtgcatttctttcgttttaagcaattcccgtaaagaatcaatttgaactggacataaaaaatcacaactccttaattttatttcaagtagaacactatctgttttaaaacgttgattatgaaatatgttataatcagactcatcccatactataactgattcgcctaaagttgccaacttagtaatatacaaatgaactttattagtattctcataagcttcattaatttgaattatcagattctcaagttctttcaaccggcaacgttcatttatcattacagtaaccatacttaagactataaatcctgtaataaaatatccaataaatagtcttttgcgtaataatgaagtcatcaggaacattctattgatttatttgacatcataattctatatatttaactagtcatagtatatatcattctcaaatatttatttcaaattcaagcaataaaataaaaaaacacttcatattacaactgaactcttttatgaaaaagttgaatatatgaagtgtttttttattacgatataaactataaaatcctattcttcgggaactggtgtataaacccttatccagtccaccaggaaggtgtggtcttccacatttttcagttcctcatccgtagggcttaaacctttaacggctctccagctttggtcttccatatttattatgatgtccatgtcttttaccagacctgtaccaccagtgtagttgttggggtcgataatatccttgccgcttacggttctgacaagttctccatctacataatattcaagtgtgaaagggtctttccagaacactcctacacgatgaaaatcgtcgcgccacaatgttcccttgtcatccttataccatgagccaagatctttcggctgataatccttgaatggctggcggatgaatatgtgatggctcaggtgaagtctgtcggcaccgtaacctccgccgtctctgtcgccgccgtatgcttctatgatgtcgatttcctgagtatcgtcagggctgagcatccatacatcggatgccatggttgaatttgaaagttttgcgtatgcctctacataaaccggatactttacacgtgtcttcgatgtgatacatcccgtataggttcccggcagttcctttgtgttgggtccgcttacaactttcttcatggggacatcttcaggacggctggctcttattttaaggtatccgtcggaaacggaaacatggtctctctgccatattgtaggagcaggtcctgtccaatgattatgatagaaatcggtccatttggcatagaactcttttcctttatccttttcgtcggcaacataattaaagtcgtccgactgtggatggagtttccacaccataccgtcgccggcatcagcgggtacaggatagatatcccactcgtacgatttattattgaaatcttctgctgcacaggctatttgcagcgatgctaaacaaatggtaaacagttttctcatcgtggtatcttagtttaagttataataattattttcgttcttttgattcacctttagcggtatgtgtctgcaatgtccaggtagaaaatctcattatgctctgatagtctgaactgttgtatatatgagtaagaccccatctcaatatttcggtaggttctttttcggcatctgcactgcggttcaggccaatggcgtgtggcgcgccttttactactgacattatttcaaagtttattccgtcaggcgaccactggagtgtgttcttttcaggaccgtcggtggtgataagtgaagctatacctcctttgtaaggccatacgcaaacttcatgcccgctgtttgaaataggattatattccgatttcacatacggacccataggattttccgcaatagccactccgtgtttgatttcacggccgccccatgttatttcttctcccatacgttcgcctttgtagtacatatagaacttacctttataaggtattatacacgggtcgtgtaccttatgactgtcgaaatcacctttcgacactaccttgaatctgttatcctcatcgccttcccattcgccggtattagaaggttccagtacaggcttgtctgtcttgatccacggtccttcaggggaatcagcacatgccataccgatagtattctttacacggactgtgtaaggggattttaccgcctgatagcaaagataatactttcctttccattccatcacctcaggagtgaagactgaacggtcgtcgtaagcacctttttcaccacgtttcactgcaattccctgttccttccatgtccatccgtcttttgatgtggcataccatatatcacatctgtcccatgggaaaaccttatctttctctatatctccagcaaatccttgggtaggtccatagctctttgaataccatacataatatgtattacctattttcagcattgcactcgggtctcttcttactacgccctcttcataagcaagatcacctttaagtggttccatcttatactcaaagaaccatttattgtcgtgattttcccatttcatggcacgtttcatagctgcacttaacttatttcccttaggtattcccaatgaatcggccttacgctcatcataattctgagtgtcgtcaacggcaatagtctgtgtattgcctgtatttccgcatgctgccaatagcgacatcatgccggctgcaagaataatttttctcatactagactttattttatattaattgttagtttattcgagtgtaattcacttgtttctgcactgatattcagtaccgatgatttttctgtcgactgaagcatcagcatacatcttccctgatatgtcataatatccttactttgatatggagaaacgttcttcacgtttccattgtctataccaagcagacggtactctccatcaatgttgaacttaagcatctgttctgttgtctttacaggattaccttttttgtctgttagctgagctgtgacatgcagaacatcctttccatttgctgcgatactttgtttgtcaaccgtcagcaatatcgaatgttctttgcctgaagtccttatagctgtagtggtattacctaacttattttttccttttgcggtaatagtgccaggcttgtactgaactgcccatttatagatatgatcctcaaaatcgtctatatacttctttcccatcgacttaccgttaacgaaaagttccacttcatcacaattggaatatatctctactattaccgagtcacctttctgataattccagtgagagtttacatcatcccaaacccataattttctatcccattcatgtcctttcttatcagtaaatccatcttttacatggagatacgaagatttgtctgtagtctgtgaatatatagcaataaaaggcttgtctgtccacaatgatttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtacccattataggcttgtcaggataattcttcttagcataatcatacatcacgcgacggtagctgaagcctgccacatcgagcgcgtcgatatatcctgactcaaagcttatggaaggcaggatgcagttggcggtaactacacgtgtggtgtccatctggcgtgtccatgcagctaatttttgcgctgtacggccaatgtcgtatgcatgtttaggctggattttccacatttctctgattttttctttagagtatggaggctgattccagaaataattaccgttggaatcggcaccgaagaaacctgtcgcctcgcggcatccggtataagtccattctatttcattacctatactccactggaagatacaggcatgattacggcttctcctcattacgtttttcaaatctctttctgcccattcctggaaatgctcgcaatagccatgcgtaggatagtcttctacagtttccttcatattgagtcttttatctttgggataatcccactcatcgaagaattcttcctgaaccagaagacctatctcatcgcacaaagacagaaactcttccgctcccggattgtgcgagaggcggatggcattgcatcctccttcctttagggttttcagacgccggtaccacacatcgcgtatcattgccgcgccaaccattccggcatcatggtgcaggcatactccttttatcttcatgtttttcccgttaaggaagaaacctttgtctgcatcaaaacggaatgtccgtatgccgaacctgacagtgttttcagaaattacttcatcgccattcttgatgcgtgtctcggctgtatagaggacaggtgtatcgacgctccacaaatcaggctgtttaatctcagatacgatgtcgataattttctcctcaccagcattcagttttatactgaagacctcaaaggctgcgatattgcctttattatccttatatactacctcaacaactgcagctctgggttcggagtagctgttgcacacggtaacctggttgtttactttagcatatttatcagtaaccacgggagtagtgacaaatgttccccaaaccggaatatgcagtctgtcggttacaatcattttcacatccctgtatatacctgaaccggtgtaccatctgctgtcggcataatggctgtggtcgacccttacagtcatacggttatcctcattgggattgagatagtctgtgacatcaaaataaaaaggagcatatcccgaaggatgatatccaagctttttgccatttatccaatactcagaattattatatactccatcgaacactatatagcatttctgatttgcactgattgttgtgggaaatgatttgctataccatcctattcctccctgaaggaaagctacacatccttcacccgaaatggaatcgtaaggtaaaccaacactccagtcatgtggcaggttcactttcttccattcatcaccagggacataagaagtatatgaataatgagcagaatctttcagtacgaatttccaatctttattgaaatcaacatttgaatcagatgctgaaacctttagggttgataataggattattaaagctaaaagatttttatttctcataatcttaggttttacatgttttttgatgtcacaaaactatatctttcacttataatatatgagggggatattaatgtgatatagggtgggaaatcagaattttacatctgccctgtattccaccgtcacctacaaccttgacaaaggatgttcctttcttccctcttatggttctcaggacaaacagacactttccgttatatgtccttacactattgtttatgacgttgatgttcaaatcttctatcgaaggcgatccattgtcgagtccggcaagttcaagcttgtcgtcgaggattatcctcacatccgaaggtatatcgactactgtgtttccttctttatcttcaatggatacttctacatggataaggtcataaccgttgtcggtagctgttttgcggtcgcagttcagtgccagacggcacggcttgccgcttgtggacaaagtgtctttcgacaatattctgtcgccgtccttgcctaccgcaaggagtgttccttccttgtatgccaccttccacatcagtatattatgctccatgaaatcgctgcgtttctttgttcccaacgatttgccgttcagaaacagttccacttctggggcgttggtatatacctgcaccagtatgtcctcgtccctgcggtacttccatttatcgcgtgtgtcgtaccactcccagcgtctgatccatcccgggcgtggagtgtaggtgaaacttccgtcagtatccatcttgaactcgctttccttttcaggtattgttacaatatgggttttcggtgtgtctttccacagacattcaaagaaatggccacgcgctgtcttgttgcccacgaaatcgaagaaagaacagtctccaccccttgcaggccatgggccgttctcgccaagatagtcgaatcctgtccacacgaagatgcccgctatgtacttcttgtcggccacggctgtccattcaaagagctgaccaacattctccgaaccgataataggctgatatggatatagcttatggtcgatttcataatatttgtctttatagttatatcccactacatcaagaacgtctgtatatccggagagacgcgaaactgacggaacaacgactcctgaagagacgggacgggtagtgtccacatccttaacccaaccggcaaggacagcggctgtttcagccaaatcgtcttttcctcctgacagacggttgaactctttcagtatagacttgttgtctgtttccgggtcgcccgtatggataagacccttgaaccctttattgtctttgctcgatgcccagtaatatggataggtccattctatttcattgcctatactccagagtatcacgcaaggatgatttctgtctcgcctgatgaacgacttgaggtcgtgctcggcatgcgtatcgaagtatctggtatatcctattgatatgctgtcgggcgcatcttccttagctcgctcagtaatccactttttctttgccaccttccattcgtcgataaattcattcattacaagaagtcccagactgtcgcacatttccagcagactttccgaatgcggattatgggctgtacgtatggcattgcagcctatggaacgaagtttcagaaggcgtcgcaacagggcatcatcgtatgcggcaacacccatacatcccaagtcgtggtgtatgttcactccttttatttttactgattttccgtttagaaggaagccttcatccgcatcgaatttaatgtcgcggataccaaattttgttgttttcttatccatcacatatccgtcagaagcaatcagagtagtatgaagctcatacatcgaaggcgtttcaagactccagagatgacaattctccagttcaacagatgcagtgaactcattgaaatcgcctttcagggcaacaaaatcatcggaaacagaagctattgtcttgccgtcgtacactacttcgtgcttcacggtgactccttttacacctgttccagcattcttcacctcgcataccacattcaccatcgaacggttgcctacctgtggtgtggtaacgaatattccgtctgaaggaatatagagctcgtttcttagaataagactcacattcctgtatataccggcaccgacataccatctgctatcggcatacgctcttctgtcaacgcagacagttattgtattcatcgaaccttttggtttcagatattgagtaagttcatattcaaatcccacatatccgttaggacggaatcccaacatatgcccgtttatccaaacctttgagttattatatacaccttcgaaatgaatgaacacttttttcccattcatatcatccgaggtgagaaaattcttcatgtaaatccccacaccgccagacagaaaaccattgcttccggctgtctgagtcttggtatatccttcgctgatactccagtcatgaggcagacacacatcctcccactttatatctggactcaggaacaaagtgtcctgaggcacgaaacctgctggtttgctgaatttccaatcgaagttgaaatccactttagtggaggttccggcataacagaatccggacagaaagatagttaagactgtgataatgttttttatggtcatatcgattttcagattaatattaatgacaaaaataatttcaaaagtgtaaaaacaaaaaaactctccatttatatttcagatatcaacggagagtttcatcattaaaaaaaataaaacattttataaagttactccttgcttaaggatagctatttcccggtatcccttcttttcgttcagtgcctgctttccgcttgccacttccaccacaaagtctataaaacgtctgcttaaagattccatgctttctccctctaccagagttccggcattgaaatcaatccacgtatgtttctgttcataaagcggagtgttggtcgaaaccttcacggttggaacgaatgttccgaacggtgttccgcggcctgttgtgaacagcacgatatggcatccggcagaagcaagagccgtacttgccactaggtcgttgcctggtgcgctcaacaggttaagtccgtgtgttgtgacacggtcgccatatttcagaacatcctccaccatcgagcttcccgacttctgtgtacatcccaatgatttctcctcaagcgtggaaatacctcccgccttgtttcccggtgaaggattttcatatattggctggtcgttgcggatgaagtagttcttgaagtcgtttatcatggccactgtgtcgtcgaatatctccttcgtgcggcaacggttcatgagcagtgtctcggctccgaacatttcaggtacctccgtgaggactgttgtcccaccctgggcaacaagatagtcagagaacaccccaagcatcggattggccgtgataccggacagtccatcagacccgccgcacttgagtcctatacgcagttttgacagggggacatcagtccgcttgtcttccctggctatggcatacatctcacggagaagtttcataccctcttctatctcatcatctactttctgagaaacaaggaaacggatcctttgggtatcatagtcacctataaactcacgaaaggcatcaggctggttgttctcacagccaagacctacgacaaggacagctccggcattgggatgaaggaccatgtcacgcaatatcttacgggtgttctcatggtcgtcacccaactgcgagcatccgtagttatgagggaaagatataatggagtcaaccccctcgcaacctgtttccttgcgaagctgctcggccaactggtttactattccgttcacgcaacccaccgtagggataatccatatctcattacgtatgccggcttctccgttagcacgcaaataccctttgaatgtatggttctcgttcgtgaatgtctgtttctcgaacttcggagtgtaagtgtatgtactcagaccggaaaggttcgtcttgacggttttctcgttcagcagatgtcctttcctgacttcctttacagcgtgcgatatggggaaaccgtattttatcaccatatcaccttctgcaaaatccttcagggcaatcttatgaccggcaggtatatcctccattaattctatggaattgccgttcacctctattacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagtatcggcgagaactgtcttcacaagattttctaccgagccatcgttccacaaacttgtaagcatcgccatgatttcctgtgcatcgttaggaactatctctacaccatcggcacgctttccacctttgtagtatactatgatggctgcaagaccgagtacaagtccttcaggaagcacacccttacgtttcagatattccttcactcctggaaggtcgcgtgtggcatacttagggaatgagttaagcatgattgatgttacctgatggtctacgaaaggattattgaaacgttccaggacatcatcggcaaacttcttgagttcctctttcggcaggttgagggtctccatcagctcgtcgaacatcacacgtttgatgaacttgcctatcacctcatgttggcatgcgtctctcacgatattgacgcccgaaaggaatgccaccggcgacaatacagtgtgaggaccgttcagcagagtaaccttgcgttcatgataaggctcctccgacgggacgaacagaacgttcagtcccgccttgtttgcaggaaattcttcggcaaccgattccggtgcttcgataacccacagatgaaaagcctcgccctgtacaactaaattgtcatcaaagtatagtttagtttttatgttgtctatgtctttacgagggaaacccggtacgatacggtccaccagtgtggcatatacaccacatgcagtttcaaaccatgacttgaactcttcgccaaggttccacaattcaatatactgatagattgtttccttcagtttgtgaccgttgaggaagataagctcgcatgggaagatgatgagtcctttcgacttgtcaccgttgaaatgtttgaatctgtgataaagcaactgtgtcagcttgcccggataagagcttgcaggagcatcctcaagcttgcacgacggatcgaagttgataccggcctcagtagtgttcgagattacgaatctcatatcaggctgttccgccagtgccatgaagtcattatactggctgtatggattcagcgcgcggctgatgacatcaatcattctgaatgagttcaccacctcgccattgttcagtccctgaagattgacatgatacagacagtcctgggcattgagggcatcaaccatacctttttctataggctgcaccacaacaacactgctgttgaaatctgtcttttcattcatattcgagataatccagtcgacaaacgcacgaaggaaattaccttcgccaaactgtatgatacgttccggacgtactgcctttactgcagtcttactatttaaagctttcattgtaatgccaaaaaattaaaattgataagattaaaattcaaccaacattctgaataccttacctggattttccgaccatttctgcagagcctcgcctgcctcttcaggtttcactacggcagagataagttcgttcatcgggcagttgccattctgaagataatgtatcacggcacggaaatcctcaggcattgcattgcgcgaaccgcgtatgtcgagttccttctggacaaaatattttgtctggaaagccacttcactcttggcatagccgatacatgccacacggcctgtgaaacctacaatgtcgatggcagtaacatatgtgataggactacccacagcctctatcaccacatcagccatatagccgtcagtaagttcccttactctttccaccacattttcagtcttcgaattgataaccatcgaagcacccaggcgttttgccagttcaagcttctcatcgtcaatatccaatgctattacccttgcgccacgaagcgatgctcttactatggcgccaagtccaatcattccgcaaccaatcacggccacagtatcaatgtcagttacctgagctctcgacacggcatggaaacctacgctcataggctcaatcagcgcacattccttatccgaaagaccggcagccggaataacctttgtccaagggaggacaaggaactcctgcatagaaccgttacgctgaacacccaaagtctcgttgtgttcgcaggcattcacacgtccgttgcggcatgaagcacactttccgcagttggtatatggatttactgtcacgttcattcccttctcgaaaccgacaggaacgccttcgcctatttcctctatcacagcacccacttcatgtcccgggatgacaggcatcttcaccataggatttcttcccaggtaagtattaaggtcggaaccacagaatccgacatatttgatacgaagtaaaatttctccggctccaagtgttggtttaactatatcagctacttgaacctttccggcttcagtaatttgtacagctttcataatctatgtatttatttaaatttgttattgtattattttgatgttgcattaattcaatgttgttttttctctatcttatatcctctccagccataatatgccgtaaagaagaaacatatcagaggtattacatatgccacctgatagaagtccgcgttatgattcatcacaaatgcggtgaactgagggatgcacgcattacctataatagccatcacaaggaatgccgaaccactctttgtgtcctcgccaaggtcgcgtagtgcaagtgagaactgggttggatacattatcgacatgaagaacgacactgcaagcatggcataaagtcctgtcataccaccgaacatgataattactccacacagtatgatatttactatagcgtatgtaagcagcatatcctgaggtctgaatttcgacattagcatagtacctatccatctgccgccaaggaaagccagcatatacagtccgaagaatgtggtcgcctcatcctccgacagacctgcatacatgcagcagtaaactaggaacaggctgttgatggctgtctgccctccgttatagaagaactgtgcgataactccccatctcaggtgtttgcgtttcaacactgcaaaattgataagcttgcccttctcgccgtgcgattcctccttgtcaatatcaggcaacttatacagtgcaaacaccacagcaagaataatcagcaggactgcaagaaccagataaggcatcttcatggagtctgtctccatctgaataaatccgtcccaacctccgggaaagtcggcaggcagagtctcgcgagtatagttctgtccggtaagtataagcttactcagaaacattgcggatatgaaagcaccaagaccgttgaacgactgtgcaagattcagtcttcttgaagccgtatcgtgtgtacccagagctgtcacatacggattggcagcagtttcgaggaagcacattcccgttgccatgatgaagaagattacaagatatgcccagtattcctttatctcggctgcagggaagaaaagcagaccaccgatggctgcaagaatgagaccgacaattatacccgacttatagctgaaacgtttcatgaacattgctatcggtatgggaaacaggaagtaggccagccaataggcagcttcagtgaacgaggcctcaaaagcattcagttcacaggttttcatcaactgcctgatcattgtaggcaatagattactgctgatagcccacatgaagaacaagctgaatatcagtaaaagcggtataaaatatttgtttttcattctgacatgtttttaatataaggtaactcaggcagattcttgaaaccgtaaaaggctttcgcgttctcgcccaagaaaagttttttgcttctctcttccaattcttttgatttaatcacaaagtcgtacgacatcttgtaggtaatggctgtgattgtgcgtggatagtcggaaccccacatcagtttctcgaagccaacaaggtcggcagcttcgttgatggctctgacagcgctgcggaacggatagaactcgtcattgaacagccaagtgataccgcccgactcaatcatcacattcttatgacgggcaagcattatctgcttcttccaatccggtttagtcaccataccgaaatgcccgatggcaatcttcaagtacggacattctgaaatgatttcttccatctcgcccacctggaggtctccctctgccatatctatggaaagaatcacccccttgtcttccattagatgaaacatcctcatcatctcgtccgagttgagcatcaccctaccgtccttcagttgcaggcggtgtcccggaatctttatggccttgaaccctttgtctataagttcaaccgcctggttatagaaacccggttttctgaattcacacataccacacacgaagaacctgtccggatatttcgtcatcacctccatcagatagtcattctgaatgccgtcgatatactcctgtgtgacaacagccgcgccaatcagggcataattcatattagccaggaaaacctcagccgtgtttcttccgtcaatcataaagggggggggagcatttgtctcacctcccccataaacaatgattgaccgttctctgtagtcttgattttcaggccatctacttcagtgtcctgataaagccacagatgcgaatgggcgtcaattattgtataatccatagaaacagtatttatgaatttgcccaacttactctttgctgatcgcctattatctccttaaccttttccacaaggctccagtctatcggttcctcaatgtattttatgttctgaagcacagactctgttcttgccgagctgaacaatgttgtaggtattctcggattgcttacagagaactgcaccgcaagtttctcgatagggtatccctgttcagcacaatacttggcagcctttgcacacacctcaatcaatggttttggagccggatgccattcaggaacacctctatgtgtgagaagtcccataccgaacggcgaagcgtttatcactcccacaccattttcgtcaaaatagtcgaggaagtccaccagcttgtcgtcgttcaatgaatagtgacagaagttaagcaccgcctctactgtacccggagcggcatggtcgataatccatttcaggttttcgagctgcaggtcggtgatacccacgtggcccaccacgcctttcttcttcagttccaccagagcaggcaatgtctcgttcaccacctggttcatatccgagaactcaacgtcgtgaacgttgataaggtcgatatagtcgatgttcagacgttccatactttcgtaaacactctcctgagcgcgtttgtccgagtagtcccacgtattcacaccgtccttgccatagcgtcccacctttgtagaaaggatgaacgattctcttggcaattccttcagagccttacccaatacggtttcggctttataatgtccgtaatatggagaaacatcaataaagttcagtccgcgttccactgctgtaaaaacagactgtatagcgtcactttctttgatagaatgaaaaactccgcccaatgaagatgcgccataactcaatacaggaaccttaagtcctgtctttcccaattcacgatattccatttttgataaataatttaaaggttaatattttttactctgtttattcttattcatacagatagaacatacgttccatcatcttccatttctcgtccgatgtggccccctcggcacactgctggaatttggctacgtattcttcccattcggcctgacgcggcagagtggcaagctttgccatagctgtatcccagtcaaaatccagaggtgtttccactatcataaagagttttgaccccaatatgtatatttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatgaagtatccatcaaaacaatagaggagattttcaaaaaagaaagaggggatattataccccctctttttcgacatttttacccctcataaaggagataaaaagtcaccccaaactctataaaaaatcaaaacagattgaactgcattcctgtgtagaaaaatccctggttggatttcggattccaatacgtcatcaccgtcaacgggatttcatattccataatccgaagtttataaatcacattcagggacacctgagtaattcctgccgattcggcatacatggttctgttcaccatttccccgctttcatttcttgaatttctcaatgcgaaagctgttccaataccaggaccgacccttagcttttcgttctgatagatggtatagcccacatatacgaaactggagtagatgttcttgctgttgtccagatccctgtcgcgaccgtaaacaagtgtagagaagctcaactccagcggaaatttcctgtcgcccgtataattgaccatgagatcaacgaaacgtccagtttcatcaggcttatagttgaagaactccttattattatatgtagccccgggcgagaaattatatgtatctatagcctttatctgaaacctgccatgagtatatgctatatactggctcagctccttataactccccctggtgttcgatccgccaaggaaaccggcggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaataagacagggatttcaactccctccgatctgcatagtctggtggcttcgctatgcttttactcctacatccattttttttctttcttttttcctctgttcccgttctttcctatccttcgtgtgacatttgatgacacctgatgacatctaatgtcatctatttgtaaatcaattgtttactcaatttatcatcttacatttggactgtgaaacaaatcaagtagtcactcaaaacaaaagattatggcacaagaaaacagtcctgacaaggaaaaaaggcaaggccggacaaagaaacccgaaaagccttatgtggaacaaattgacgagcttctgctggtacataacaagaatgacccaaaggaaggtttgggagtaatcagcaagatggacgagaaaggcaattatcagacggttacaccggaagagaagaatgagaactcattcctgaaattcgacaagaattcgagtattctcgaaaacttcatcaagaatttctggagccagctgaaggagcctacgcatttcaggcttatccgtatgaccttcaatgattacaaacagaacaaacaggctctcaaggacctggccgaaggcaagaagacagacgcggtaaaggagtttctgaaacgctatgaaatcagaccgaaagtaaacaatcagaaaaacagtcaaacaaaagaggaggaaacaacaatggcaaagaagcaggaacagacaacgcaggctcagcctgaacaggtatcacaggtggaagctgccgcacaggggcgcgaacagcaggaaccgcaacgccagcagacacccacgtaccgctacaacgagaacatgattaattgggaggaactgggtaagttcggtatatccaaagaaatgctggagcagtccggacagcttgacagcatgttgaaaggatacaagaccaacagaaccatgccgctgacactcaacattcctggggtactgaccgcaaaacttgatgcacgcctttcgttcatatccaacggcgggcaggtcatgctgggcatccacggtatcagaaaggaacctgaactggaccgtccttatttcggacatatcttcacggaagaggacaagaaaaacctgcgtgaaagtggaaacatgggacgcgtggctgaccttaacctgcgtggcaacacgacagagccgtgtctgatttccatcgacaagaataccaacgaactggtagccgtacggcaggagcatgtctatatcccgaatgaaatcaaagggataaccttgactccggacgaaatccagaaactgaaaaacggagaacagatattcgtagagggaatgaagtccaatcaaggtaaagagtttaatgccaatctgcaatatagtgcggaaagaagaggcatcgaatttatcttcccgaaagaccaggctttcaaccagcagacgcttggcggtgtaccgctttcccccatgcagctcaaagcgttgaacgaaggacacaccatccttgtagaggatatgaaacgaaagaacggcgaactgttttcttcctttgttaccatggacaaggttacaggcgggctccaatatacgcgccacaatccggaaacgggagaaatctacataccaaaggaaatctgttcggtacagctcacaccggaggacaaggaagcgttacgcaaagggcagcccatctatcttgagaacatgatcaaccgtaaaggtgaggaattctcgtcattcgtcaagctggacctggcaagcggaagaccacagtattccagaactccggacggtttcaacgaacgacaggcaccagccatcccggctgaggtttacggacacctgctttcggcacaggaaagagctaatcttcaggacggaaaggctatcctcgtaacgggtatgaaaggtcccaacggcaaaccgttcgattcctatctgaaagtaaacgcaaacaccggacagctgcaatatttccaggaaaatccggatgtgcgccgcaatacttcacagcgtgcttcacagactgacaatacccagcagcaggaacagaagaagggagcaaaacaggctgtctgacctgaacgggattcaaatcattcaaatcatcaattactaaaaaaggaaagaacatgaacaagaccaatcatcatatctacaagactgaacaaatcgactgggagaaactggaatcggtaggtatcagcagatcgcaaattgaaaaggacggaaacatggacctgctccttcagggagaggaaaccaatgtcatgtccattaaaatcaagactcctgtattttcactgaccatggacgccacactcagtctgattgaagacgagaatggaaatccggtcatcagcgtaaacggtatcaacccttcaggtgaataaataagaaaccataatgtatcatctctctttccatacggacttaccgtatggaaagagataaaaacagaatttatcatgattgccatattaacagacaaaccaagtgtaggaaaagaaatcggaagaatcatcggtgcaaccaaagtaagaaacggatatgtggaaggaaacggctacatggttacatggactttcgggaacatgctgtcactggccatgccgaaggactacggaacccagaagctggaacggaatgactttcctttcatcccgtccgaattcgaactgatggtacggcatacacgcaccgagaacggatggataccggacattgatgccgtgctccagcttaaagtaatcgagagagtgtttcaggcatgcgataccatcattgcggctaccgatgccagccgtgacggggaaatgacattccgctatgtctatcaatacctgaactgtacactgccttgcttccgtctgtggatttcctctcttaccgacgagtctgtgcgtaaaggcatggaaaacctgaagccggacagttgctacgacagcctgttccttgctgccgacagccgcaacaaggcggactggattctcggaatcaacgccagctatgccatgtgcaaggcgacgggccttggcaacaattctctcggacgggtacagacaccggtactggctaccatcagcagacgctaccgtgaaagggagaaccatatttcatcggacagctggcccatctacatcagcctgcaaaaggacggcatccttttcaagatgcgccgcacacaggatcttcccgacaaagaatccgctacaatgtttttccaggactgcaagctggcacatcaggcacagattacaggtatcagccacagcgttaaggaaatacttccaccggacctgcttgacctgacacaacttcagaaggaagcgaacatccgctatggttttaccgcatcagaggtgtatgacatcgcccagtctctttatgaaaagaaactgatttcctatccgcggacttccagccgttatctgacggaggatgtgtttgactcgcttccaccaatcatggcgcgtctgctttcatgggagctgttccctgcagctaaaggaactggaggtattgacatatccaatttgtcccgccacgtaataagcgcagaaaaagccaatgtacatcatgccatcatcattacaggtatccgtcccggaaatctgtccgaaaaggaaatacaggtttacagacttgtagccggaaggatgcttgaaacattcatggctccatgccgcatagaaacgacaaatgttgaagcggtttgtgcggcacagcatttcaaggccgaacaaacaagaatcattgaagccggctggcatgatgtgtttatgcgttccgacatggttccaaaatcaggatattctgtcaatgaactccccgaagtggagaaaagtgatactctgaatgtatgcggatgcaacatggtacacaagaaacagctgccggtaaatccgttcacggatgcagaactggtggaatacatggaacagaacggactgggtacagtatcctcacgtaccaatatcatccgtacactggttaaccgtaagtatatccgttattcagggaaatatatcgttccgaccccgaaaggcatgttcacctacgaaaccatccgtggaaagaaaattgcggatacttcactcaccgcagactgggaaaaacagctggccggacttgaaagcggaatgataaccggacaggacttcctgaacaggatcaggactctcgccaaggaaatgactgatgacattttcaacacctattccacaaaagaagaataacatctatacctaatcaaccaagagaatgcaggccggaaggtctgcatttttttgtatccgtacagaaaagaatctgtttttccgcttttaagcggcaaaggtcttggattgcctgccttttgccgcaaggctgccctcatgggcttggctggacaggaaaaaatcatcctcgctgcgctccggtattttttcctgccaggccttgcgcaaaaaggcaatccaagaggccggaggcctataaaatcgggaaaacacatcccgatgggattattcattcataaaattaaggattatgaaactacagattatcagaaagatcggcagacatgcaacagcgatattcctgattaccggaatatgtctgctgacaagtaaagggattgtccctactgggatgattacgctgctgttgcttgcaggagggttcatcggttttctgttcaggatactggtcattattttcaagattcttattcttctgttcattgtaggattatttgtcgcataacccaaaatataaatatacatatatggaaacagttgctataacctcacaagctcctgtcatgccggctgtatggccacagaacgaacatatcagaccggttaaaagacgtctgcccaatacagttgatgaacctaaaaatatcggctactatctggaatcgctacgtgatatttccagcaatccggacagagagaatattctgaaagaattcttcaaggaaacttatgtataaccataaaatttttcaattatgttttttcaatcaatttatcagatgattacagcaggtacggatctgaatatcaatatccgtaaagtggacaacagcctgagcgtagcagtcatgccaaggcggaacagcctgaaagaggatacgcgacagaacatggtgccactgatcgtgaacggaacaccggcagaactggatatgggcttcctgcagaccatactccaaccgatacagaaggtacagggactgcttgtcaatgcggaaaatttcgagaaacaggcagaaaaggctacatcacaggccaaatcatccaaggctccaacaataccggccgaatcaaaggaagccagggaaaaacgggaaaagatggaaaagctcctcaagaaggctgatgaagcaaccgccgcaaaaaggtactccgaagcaatgacatggctgaaacaggcacgggtactggctcctacagaaaaacagaaggatattgacgaaaagatgcaggaagtacagaaacaggctagtgcaggaagcctgttcggtatggcagaggaaccggcgccggtaattccccaaccacaaggctatatgaacggtcagtcacaaccaggtatgcaaacaagcatattcccggagcaacagacccatactatgaatcctgaacctgtcatgcagcctgctccacagcaggtatcacaacaaattccacaaggaatacctcaaccggcatatggaacgaacgggacatataacccacctgctccaaacagcccgatagtaaaaggagcagacataccgcaaggcgcaacaatgcatccttacccacagcagccatactaccagcaagaggcgactccttatccaacacaacagccacagcaaccgacaaacggacatataccgaatggggctgcgcaagtacagaatggaaacggacgggaataccagactgcatcggctacacatgagacattctgcttcgatccggaagacgagaatgacagggaacttctaagagaggacccgtatgcggaatatccggattttccggctgagtaccgaatgaaggacgaggcacaggtagaaatggtatactgctgatatacacaataaacgatttgtaaaaccaataaactataaacaatatggcactggaaattaaaggaatgaaaagagtattcaagatgaagaagaacaatcaggaaatcgtactggatgatccgaacgtaaacatgtctccggctgaagtgatggacttctattccatgaattatccggaactgacaaccgcgaccgtacacggaccggaaatcgaagacgaccgggcggtatatgaattcaagaccactatcggagtaaaagggtaagagcatgaaaaaaggacaacgtaaagacaagaaaccatgtacacaacttacggaacgggctttggaaaatttagccagacttatcatatcggaactcgaaaatacggacataagccggggcatcaggaacagaaagaaaagaagactccctcccgcagaaagcctcatggttttctgaacacgagaataccttccatcgctcccgatctgtatgttgagaatgacagggatgtaacggtaaatgtcaccaccaaagagaatcttgatttcctgtaccgttcagccatgaagtatgcgcagctcctggatgtggagctgccataccatcctacaggcaggacttccacaagagagaaaatatgcctgctatataatgcactggattccatagtatctcatcatgtaaatctggaacttattggtgacaggctccagttctgcatctaccatttccatgaatggccggattatacgcttttctttatgccgatagactttacggaaaggctgcacggtgaaattaaaaagattacactggagttcatcagaaagttcatcaaatatcacaggatgatggatataaccgataccccttattttgagatgtcggaagtctgtatcgattatgtggactttgaacagctcgatgaggaagagaaaaaggatttgtacagaaaggaaaagcttttcaggtcatatgagaaagggagaatccacaggaagctgtgccggatgcactccagggctttctgtaggaatctggaagaacatatccgcaactgtactccttccagcgataaggaaagaagacttttggaactgattaccgaagggctgtccctgattgcaaaggacagcccttatatcttgaattatgattatgattttgcaagcgaaaaggaacgggatttcgagccgccaccgctcgaatatcagattctgcttacatattccatcacggatacggttaccaaagacatggaaagctgtttcagtactgactgtcaggaaacatataaccagactcccgtatcatttaccttcatcacgccggaaacagaggaacttttcaagccggacaactatccggaacggtttgagaaatggtttgagaaatttgtagaacatgttacctataatttataaacatcatgaatgaactgaccaaaaatatgcaaaaaatgatggtaccgaaggctgcaatcatagcctacaagtatgaagacagaagaaatcttgataccaggtactttatagaattacgtccaatcagaaaaagcggacagatgggggcaggtatccccgtcacatacgaattcatgaataccctgctggaatcctatacggaagaaatgagcgggataccggcaggcagagtccctgaaaacatgctggcctgcaatccgagaaaaggacaggaagaatatatctggtacaatccgcccggaaaaagacagatgttctttcacaaggatctcaatatacaggacggcatgttcaatctgccgggaattatctaccaagtaaaaaacggaaacatggacgtgttcgctttcaaggggaaacgtccggtggagacgactccgctgttccgtgccccgttcttcaacgtgaccggatcaagtgtctgccttggcaacagttctctggaaaagccacagaacccgactttcctttccctgctggaatactgggaaaaacggttctggctgactgaattctcccatctgggaggaaatgtcaatcctaccgtttcaaatcttgtcatcgtcaccgaaaatataagaaacaatccgttcgacatgaacgaactcaagcccatgaataaaaaacttaaagacatacttccatgaaaaagatacattttaccgaccgctacctgctcaatccacgtcatccggtaacggtattcgtcatcggagctggaggtaccggctcacaagtgataaccaatctggcacgcatgagcatggcacttcaggcattaggtcatccgggactgcatgtcaccgtattcgatcccgatacggttagccaggccaatataggacgccagcttttcagtgagacggaactgggactgaacaaggccgtatcacttgtcacacgcatcaaccgtttcttcggatacgcatggactgccgaaccgaaatgtttcccaacgaagaaattttcaggatatgatacagccaacatatttatcacctgcactgacaatatacgttcacgtcttgagatttggaaatttctaaagaaaactcgtaaagagaacttcaatgactatttggttcctatatattggatggattttgggaacagccagacaaagggacaggtcatcatcgggacggtacgtgagaaagttctccaaccttcttcacaagaatatattcccatgcctaaaatgaatgtcatcaccgaggaagtggactatgcgaaaatcaaggaaaaagaatcaggaccaagctgttctctggcggaagccctggaaaaacaggatttgttcattaactccacactggcacatatcggatgtgacatattatggagaatgttcaaggaaggaaagacactgtatcgcggtgcctatgtcaatctggatacattgaaaatgaccgcaatcccggtgtaatgacagaagtgaccgtatcatctttccatcagaatacggtcacttattctatttgctacttattatttactacgttcttaccacgctggagcaggaaactctgtatctctgaggcgagatagaatgatttcccgttcttttccaccgagtaatatttaatcttgccctcttgcctgtaacgtgccaaagttctttgtgacacaccaaggagttctgccagatccacattatcaagcagtctgtctccattcatacattctttcagacgattcatctggtccagtttcttttcaatgcgggcaaatccctctaccattgttcctataagtctttcgagtatctcattatctatatatgacataattccaatgttattaagtgaataaatcgatactctcttcgtgcgcactctaagagtatgtacttatagtagtgaaaatagtatgcctgaatctaagacaaagatcaacaagcttattaggcgctgataatcaggcgtataattttttctacttaatatttagtgtaaaccaaaagtgtaaactatgtaatacagaattgggaacgggttaacacagccaccaacaatgacatctgatgctacctgacgacacctaatgacaacattttgtatcatatacatattcaaaatacatttgtacaaactcaacttttttggatatggaaatcattggaattgaaacagctacatatgaaaagacattaaaggaaattgaaaacttccttgataccattgataaattgattacagcttcttcacagaaaacaataggggaatggttggataaccaagaagtttgcctgatcctcaaaatttctccaagaacattacagaatcttagagatacagaccaaatctcttattctcaaattgggaaaaagatttattataaaaaagaagatattcagaagttcattgaaaaacacaacagaaaattatgagcaaggtaattacccaagataatgagcaagttattcagatatacaataggttaaaagatacgctaacaagactcgaagatattctgaagaataacaacccaacacttaatgggcatagatatatgaatgatgcagaattggctaattaccttaaagtatcaagacgcactttacaagaatatagaaataatggaatcttatcttattatcagattggaggtaaaattctatatcgggaatctgatatagaagaacttcttgagaaaaacagacaggaagcattccgttaaacatttcttggaattttcgttgattttcaaagcaaaaatcagtatctttgcaatactgacaaagagttgtatatcagtgcagaacaaagaagttcaatcgaggtgaaataggtggactaaatgacaaacaacaagataagtaattgattattagcgataaaaaatataaggttccgcccccaggcggatcactgaaaacaaaagagaaat

SEQ ID NO: 73 - DNA, 72558 bp, Artificial Sequence
  Description of Artificial Sequence: Synthetic polynucleotide
aacaaatactttcaggacgatgtaaagtcctgagaaatcaaactgaatggatagataaatattagtcttttctcatcggattcttttaatatcgctactcttttattatgtagtggttgtattatcttaaataaaacaaaaacacccgactttacattcttgggtgtaaaacagggtgtttgttttgcaatctgctgattttcagcgttttttgcggagagacaggctctcgaacttatactttcacagaatatcataaaactgcaaacgactgataatcaagtgtaaattacaatatagagtaaaagtaaatgtttctaaatgtcttttgctatctcaataattgggtgtatatttgggtgtagaatttcaaacgcacccaattatgaatatcaagcgcaacatcatttttgcattggagagccggaaaaagaacggtgtgccaatcgtagagaacgtacccatccgtatgcgtgtcatctttgccagccaacgtatcgagtttacaacgggctaccggattgacgtagccaaatgggatgcagataagcagcgggtaaagaacggatgtaccaacaagctaaagcaaagtgcagccgaaatcaatacggacttgctgaaatactatgccgaaatccagaatattttcaaggaatttgaggtgcaggaggtcatgccaacgacccaacagttgaaggaagctttcaacatgagaatgaaagataccagtgaagaacagccggaagaagcccctgtcagcttttgggaggtgttcgatgagtttgtaaaagagtgcggtaaccagaataactggacggcatccacctatgaaaaatttgcagcagtgaggaaccacctcaaagagttcaaggaggatgcaacgttcaactatttcaacgagtttggattgaacgaatacgtcaacttcctgcgtgacaccaaggatatgagaaacagcaccatcggcaagcaaatgggattcctcaaatggttcctgcgctggagcttcaagaaaggacatcatcagaacattgcatacgatacgttcaaaccgaaactgaaaaccacctcgaaaaaagtaatcttcctgacttgggatgaactgaacaagctgaaagactaccagatacccaaggataagcaatacctggaacgtgtgcgtgatgttttcctgttctgctgctttacgagtttgcggtattcggatgttcgcaatctgaaaagaagcgatgtgaagtccgaccacatcgaaataaccacagtcaagactgccgacagcctgacgattgaactgaacaaatacagcaaagccatactggacaaatacaaggacatccatttcgagaattacatggctctgcccgtcatcagcaaccagaagatgaacgattacctgaaagagctgggcgaactggcagaaatcaacgagcctgtacgggaaacctactacaagggaaatgaacgtattgatgaagtcacacccaaatacgctttgctcagtacccatgcaggaaaaaggacattcatctgcaatgcgctggctctcggaatcccggcacaggtggtcatgaaatggacgggacacagcgactacaaagctatgaaaccctacattgacatagcggatgatattaaggcaaatgccatgaacaagtttaatcaactataaaagtatcaaacagtttcatagatagttaccaatgactgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaacggaattgatccggccacgatgcgtccggcgtagaggatctgaagatcagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgccagaagagagaaagaaggaaagcggccgcacaggtttcccgactggaaagcgggcagtgagcgcaacgcaattaatgtgagttagctcactcattaggcaccccaggctttacactttatgcttccggctcgtatgttgtgtggaattgtgagcggacaacaatttcacacaggaaacagctatgaccatgattacgccaagctatttaggtgagactatagaatactcaagcttgcatgcgatacgtatcgttaacgatggatccgacgcacgtgcgaattcgccctatagtgagtcgtattacaattcactggccgtcgttttacaacgtcgtgactgggaaaaccctggcgtcacccaacttaatcgccttgcagcacatccccctttcgccagctggcgtaatagcgaagaggcccgcaccgatcgcccttcccaacagttgcgcagctgaatggcgaatggcgcctgatgcggtattttctccttacggcggccgcttgacataacttcgtatagcatacattatacgaagttatgtttaaacattagcagaaagtcaaaggcctccggtcggaggcttttgactaaaacttcccttggggttatcattgggtcgagaccgcctgaagaggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaagcaacttcagacaatacaaatcagcgacactgaatacggggcaacctcatgtcgcctgaagagtgagaccgtcccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaaaatgtaatcacctggctcaccttcgggtgggcctttcacacttgcatcggatgcagcccggtgaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtggtaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcaacttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcgacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacctcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacgacaaaatcgcaaagtcatcaaaaaaccgcaaagttgtttaaaataagagcaacactacaaaaggagataagaagagcacatacctcagtcacttattatcactagcgctcgccgcagccgtgtaatcgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaagtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattgccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgccacagggttaagggcaatttgtcacagacaggactgtcatttgagggtgatttgtcacactgaaagggcaatttgtcacaacaccttctctagaaccagcatggataaaggccaacaaggcgctctaaaaaagaagatctaaaaactataaaaaaaaaataattataaaaatatccccgtggataagtggataaccccaagggaagttttttcaggcatcgtgtgtaagcagaatatataagtgctgttccctggtgcttcctcgctcactcgaccgggagggttcgagaaggggggtaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggtcggccgcggtgtctcgcacacggcttcgacggcgtttctggcgcgtttgcagggccatagacggccgccagcccagcggcgagggcaatcagcccggtgagcgtcggaaaaggaatattcagcaatttgcccgtgccgaagaaaggcccacccgtgaaggtgagccagtgagttgattgctacgtaaataacttcgtatagcatacattatacgaagttatggactacgcaggtcaatatccggaacatgaaacccgcaggttctgaaatccgcatattcagaacatggggattcgggaagcgcagcaatacgggcagtctcaggttcgatgctccggtcaggaaatgggaatacagagaaccgaatccgttatatgacggttacaccacccgtaactggttccgctatcatatcatgaaacaccgggacagggaaaggacaggcgaatacaccttccgcagcgattcattcacgctgtacagccggagcgagctggacgagctggccgcaatcctgaaaggcagactctacaagggaatcctgcctgactctcttgtactttggggataccgcatggatattaaggaaatatcacgtgaacagtggaacggtatgggacagcacggacaaatccgcatgaaattcatgggatacggtccggtcagaatccacacggacaatgaaaaccataccgtaacagtatacagaatcaacgacatattgtcttcaactatcagaattttcatattttttcagttctttttttgtttcttctattaatattttaagccactccatgatttgtattgcatgttcatgaacagtttcattttggctatcactgtcgtgtagtagcctttgaaaatcacgtaaaatattgtctttcccaagcatctcccatacaggcatcatccggtggattatttttctcatggtctcacggtcggttatcctgtcagcagattccatctcctccagttctttttcagattccataacaacgagagaaagcatatgactataatcatccgtattctccagtaaactggaaaaatcgaattctccggaaactgaaacttgtgtacgagatataatggtggataaaaaagcaagcagtccgtggatattgaacggtttatgaatacagcctacaaatccttctttttcataaattccggaatttccgtcaccacgggcagtcatgactgctactggaacagttctagaattgccgatgtccgaattgcgaagcaatcttaacaaaccgaatccgtcagtatcaggcatttgtacatctgtcaagatcaaatcatattcagaattttcaagagcggccactacttcacgtgcattcttacaggttttacaggatatacctttgcgcccgagcatatcttccgctattttcagttgtataggatcatcgtccactacaagaacattcttaggcaatatagttattgtattatggtccgatttgtcttcctcaactaactcatccgtttcaggcaaagaaagttccagtctgaacatgcttcctttaccgagtacactttctacatccatttttccttccaaaaccttaattaatcctttggtaaggaaaagtcccaaaccaaacccttcagaattgacattctgtgcggcacgctcaaatggagcaaatattcttttcagtgtttcctcatccataccgataccagtatcccttatttcaatacgaagttttccttctgaatattctgaatggaaattgacgttacccctggaagtaaacttaatagcgtttgtaagtagattggctaaaacctgttcaagtttgtccgcatcaccttttactattacatttgatcctttatgttcagaatataaaatcagaccttttgaagtcgctttacgagaaaactcatctgaaattcgttgcaagaaacggtcaagataaaatggtgtgtcgttacgcaaattaccggcttcattgattcggtaagcatccatcaaatcattaaccagatgtaaaacgtgtcgacaagaatgacggatgtcatctaaatatttttcgcgcttcctcttttcacgcgtttcagataccaaatctgcacagttatggatattaccaagtggacctctaatatcatgagaaactgtcaggatgattttcttacgcatatcaagcaaattctcgttttcttgaatagcttgttgtaatttaaatttaattatttcttccttacgtaaatctgattgtataattaaaaatgaaattaatattataaaaaccgcaatactcatcattacgataaataatcgaaaggattcttgtttgacttccgttacctctaagtttcgttctataaatgacagctgtacctgattatctaaaaaagatacaaaatcatataatttttgatttaacagcctattctgcaaacgcaagctatccacataagtttctatctgattgtttcgcatatctatgacagaaaccaatctattattaaaattctgtatttcattagttatataggggacttgtatcgtctccttctttccgaataatccggcaattcctttctttttctgagttattgtcttcacttttactgtttgagtagctattacaggcaattcattagtaagaatactatcagatttattcgcaaattggactgctttcattatttgaaacaagtgcatttctttcgttttaagcaattcccgtaaagaatcaatttgaactggacataaaaaatcacaactccttaattttatttcaagtagaacactatctgttttaaaacgttgattatgaaatatgttataatcagactcatcccatactataactgattcgcctaaagttgccaacttagtaatatacaaatgaactttattagtattctcataagcttcattaatttgaattatcagattctcaagttctttcaaccggcaacgttcatttatcattacagtaaccatacttaagactataaatcctgtaataaaatatccaataaatagtcttttgcgtaataatgaagtcatcaggaacattctattgatttatttgacatcataattctatatatttaactagtcatagtatatatcattctcaaatatttatttcaaattcaagcaataaaataaaaaaacacttcatattacaactgaactcttttatgaaaaagttgaatatatgaagtgtttttttattacgatataaactataaaatcctattcttcgggaactggtgtataaacccttatccagtccaccaggaaggtgtggtcttccacatttttcagttcctcatccgtagggcttaaacctttaacggctctccagctttggtcttccatatttattatgatgtccatgtcttttaccagacctgtaccaccagtgtagttgttggggtcgataatatccttgccgcttacggttctgacaagttctccatctacataatattcaagtgtgaaagggtctttccagaacactcctacacgatgaaaatcgtcgcgccacaatgttcccttgtcatccttataccatgagccaagatctttcggctgataatccttgaatggctggcggatgaatatgtgatggctcaggtgaagtctgtcggcaccgtaacctccgccgtctctgtcgccgccgtatgcttctatgatgtcgatttcctgagtatcgtcagggctgagcatccatacatcggatgccatggttgaatttgaaagttttgcgtatgcctctacataaaccggatactttacacgtgtcttcgatgtgatacatcccgtataggttcccggcagttcctttgtgttgggtccgcttacaactttcttcatggggacatcttcaggacggctggctcttattttaaggtatccgtcggaaacggaaacatggtctctctgccatattgtaggagcaggtcctgtccaatgattatgatagaaatcggtccatttggcatagaactcttttcctttatccttttcgtcggcaacataattaaagtcgtccgactgtggatggagtttccacaccataccgtcgccggcatcagcgggtacaggatagatatcccactcgtacgatttattattgaaatcttctgctgcacaggctatttgcagcgatgctaaacaaatggtaaacagttttctcatcgtggtatcttagtttaagttataataattattttcgttcttttgattcacctttagcggtatgtgtctgcaatgtccaggtagaaaatctcattatgctctgatagtctgaactgttgtatatatgagtaagaccccatctcaatatttcggtaggttctttttcggcatctgcactgcggttcaggccaatggcgtgtggcgcgccttttactactgacattatttcaaagtttattccgtcaggcgaccactggagtgtgttcttttcaggaccgtcggtggtgataagtgaagctatacctcctttgtaaggccatacgcaaacttcatgcccgctgtttgaaataggattatattccgatttcacatacggacccataggattttccgcaatagccactccgtgtttgatttcacggccgccccatgttatttcttctcccatacgttcgcctttgtagtacatatagaacttacctttataaggtattatacacgggtcgtgtaccttatgactgtcgaaatcacctttcgacactaccttgaatctgttatcctcatcgccttcccattcgccggtattagaaggttccagtacaggcttgtctgtcttgatccacggtccttcaggggaatcagcacatgccataccgatagtattctttacacggactgtgtaaggggattttaccgcctgatagcaaagataatactttcctttccattccatcacctcaggagtgaagactgaacggtcgtcgtaagcacctttttcaccacgtttcactgcaattccctgttccttccatgtccatccgtcttttgatgtggcataccatatatcacatctgtcccatgggaaaaccttatctttctctatatctccagcaaatccttgggtaggtccatagctctttgaataccatacataatatgtattacctattttcagcattgcactcgggtctcttcttactacgccctcttcataagcaagatcacctttaagtggttccatcttatactcaaagaaccatttattgtcgtgattttcccatttcatggcacgtttcatagctgcacttaacttatttcccttaggtattcccaatgaatcggccttacgctcatcataattctgagtgtcgtcaacggcaatagtctgtgtattgcctgtatttccgcatgctgccaatagcgacatcatgccggctgcaagaataatttttctcatactagactttattttatattaattgttagtttattcgagtgtaattcacttgtttctgcactgatattcagtaccgatgatttttctgtcgactgaagcatcagcatacatcttccctgatatgtcataatatccttactttgatatggagaaacgttcttcacgtttccattgtctataccaagcagacggtactctccatcaatgttgaacttaagcatctgttctgttgtctttacaggattaccttttttgtctgttagctgagctgtgacatgcagaacatcctttccatttgctgcgatactttgtttgtcaaccgtcagcaatatcgaatgttctttgcctgaagtccttatagctgtagtggtattacctaacttattttttccttttgcggtaatagtgccaggcttgtactgaactgcccatttatagatatgatcctcaaaatcgtctatatacttctttcccatcgacttaccgttaacgaaaagttccacttcatcacaattggaatatatctctactattaccgagtcacctttctgataattccagtgagagtttacatcatcccaaacccataattttctatcccattcatgtcctttcttatcagtaaatccatcttttacatggagatacgaagatttgtctgtagtctgtgaatatatagcaataaaaggcttgtctgtccacaatgatttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtacccattataggcttgtcaggataattcttcttagcataatcatacatcacgcgacggtagctgaagcctgccacatcgagcgcgtcgatatatcctgactcaaagcttatggaaggcaggatgcagttggcggtaactacacgtgtggtgtccatctggcgtgtccatgcagctaatttttgcgctgtacggccaatgtcgtatgcatgtttaggctggattttccacatttctctgattttttctttagagtatggaggctgattccagaaataattaccgttggaatcggcaccgaagaaacctgtcgcctcgcggcatccggtataagtccattctatttcattacctatactccactggaagatacaggcatgattacggcttctcctcattacgtttttcaaatctctttctgcccattcctggaaatgctcgcaatagccatgcgtaggatagtcttctacagtttccttcatattgagtcttttatctttgggataatcccactcatcgaagaattcttcctgaaccagaagacctatctcatcgcacaaagacagaaactcttccgctcccggattgtgcgagaggcggatggcattgcatcctccttcctttagggttttcagacgccggtaccacacatcgcgtatcattgccgcgccaaccattccggcatcatggtgcaggcatactccttttatcttcatgtttttcccgttaaggaagaaacctttgtctgcatcaaaacggaatgtccgtatgccgaacctgacagtgttttcagaaattacttcatcgccattcttgatgcgtgtctcggctgtatagaggacaggtgtatcgacgctccacaaatcaggctgtttaatctcagatacgatgtcgataattttctcctcaccagcattcagttttatactgaagacctcaaaggctgcgatattgcctttattatccttatatactacctcaacaactgcagctctgggttcggagtagctgttgcacacggtaacctggttgtttactttagcatatttatcagtaaccacgggagtagtgacaaatgttccccaaaccggaatatgcagtctgtcggttacaatcattttcacatccctgtatatacctgaaccggtgtaccatctgctgtcggcataatggctgtggtcgacccttacagtcatacggttatcctcattgggattgagatagtctgtgacatcaaaataaaaaggagcatatcccgaaggatgatatccaagctttttgccatttatccaatactcagaattattatatactccatcgaacactatatagcatttctgatttgcactgattgttgtgggaaatgatttgctataccatcctattcctccctgaaggaaagctacacatccttcacccgaaatggaatcgtaaggtaaaccaacactccagtcatgtggcaggttcactttcttccattcatcaccagggacataagaagtatatgaataatgagcagaatctttcagtacgaatttccaatctttattgaaatcaacatttgaatcagatgctgaaacctttagggttgataataggattattaaagctaaaagatttttatttctcataatcttaggttttacatgttttttgatgtcacaaaactatatctttcacttataatatatgagggggatattaatgtgatatagggtgggaaatcagaattttacatctgccctgtattccaccgtcacctacaaccttgacaaaggatgttcctttcttccctcttatggttctcaggacaaacagacactttccgttatatgtccttacactattgtttatgacgttgatgttcaaatcttctatcgaaggcgatccattgtcgagtccggcaagttcaagcttgtcgtcgaggattatcctcacatccgaaggtatatcgactactgtgtttccttctttatcttcaatggatacttctacatggataaggtcataaccgttgtcggtagctgttttgcggtcgcagttcagtgccagacggcacggcttgccgcttgtggacaaagtgtctttcgacaatattctgtcgccgtccttgcctaccgcaaggagtgttccttccttgtatgccaccttccacatcagtatattatgctccatgaaatcgctgcgtttctttgttcccaacgatttgccgttcagaaacagttccacttctggggcgttggtatatacctgcaccagtatgtcctcgtccctgcggtacttccatttatcgcgtgtgtcgtaccactcccagcgtctgatccatcccgggcgtggagtgtaggtgaaacttccgtcagtatccatcttgaactcgctttccttttcaggtattgttacaatatgggttttcggtgtgtctttccacagacattcaaagaaatggccacgcgctgtcttgttgcccacgaaatcgaagaaagaacagtctccaccccttgcaggccatgggccgttctcgccaagatagtcgaatcctgtccacacgaagatgcccgctatgtacttcttgtcggccacggctgtccattcaaagagctgaccaacattctccgaaccgataataggctgatatggatatagcttatggtcgatttcataatatttgtctttatagttatatcccactacatcaagaacgtctgtatatccggagagacgcgaaactgacggaacaacgactcctgaagagacgggacgggtagtgtccacatccttaacccaaccggcaaggacagcggctgtttcagccaaatcgtcttttcctcctgacagacggttgaactctttcagtatagacttgttgtctgtttccgggtcgcccgtatggataagacccttgaaccctttattgtctttgctcgatgcccagtaatatggataggtccattctatttcattgcctatactccagagtatcacgcaaggatgatttctgtctcgcctgatgaacgacttgaggtcgtgctcggcatgcgtatcgaagtatctggtatatcctattgatatgctgtcgggcgcatcttccttagctcgctcagtaatccactttttctttgccaccttccattcgtcgataaattcattcattacaagaagtcccagactgtcgcacatttccagcagactttccgaatgcggattatgggctgtacgtatggcattgcagcctatggaacgaagtttcagaaggcgtcgcaacagggcatcatcgtatgcggcaacacccatacatcccaagtcgtggtgtatgttcactccttttatttttactgattttccgtttagaaggaagccttcatccgcatcgaatttaatgtcgcggataccaaattttgttgttttcttatccatcacatatccgtcagaagcaatcagagtagtatgaagctcatacatcgaaggcgtttcaagactccagagatgacaattctccagttcaacagatgcagtgaactcattgaaatcgcctttcagggcaacaaaatcatcggaaacagaagctattgtcttgccgtcgtacactacttcgtgcttcacggtgactccttttacacctgttccagcattcttcacctcgcataccacattcaccatcgaacggttgcctacctgtggtgtggtaacgaatattccgtctgaaggaatatagagctcgtttcttagaataagactcacattcctgtatataccggcaccgacataccatctgctatcggcatacgctcttctgtcaacgcagacagttattgtattcatcgaaccttttggtttcagatattgagtaagttcatattcaaatcccacatatccgttaggacggaatcccaacatatgcccgtttatccaaacctttgagttattatatacaccttcgaaatgaatgaacacttttttcccattcatatcatccgaggtgagaaaattcttcatgtaaatccccacaccgccagacagaaaaccattgcttccggctgtctgagtcttggtatatccttcgctgatactccagtcatgaggcagacacacatcctcccactttatatctggactcaggaacaaagtgtcctgaggcacgaaacctgctggtttgctgaatttccaatcgaagttgaaatccactttagtggaggttccggcataacagaatccggacagaaagatagttaagactgtgataatgttttttatggtcatatcgattttcagattaatattaatgacaaaaataatttcaaaagtgtaaaaacaaaaaaactctccatttatatttcagatatcaacggagagtttcatcattaaaaaaaataaaacattttataaagttactccttgcttaaggatagctatttcccggtatcccttcttttcgttcagtgcctgctttccgcttgccacttccaccacaaagtctataaaacgtctgcttaaagattccatgctttctccctctaccagagttccggcattgaaatcaatccacgtatgtttctgttcataaagcggagtgttggtcgaaaccttcacggttggaacgaatgttccgaacggtgttccgcggcctgttgtgaacagcacgatatggcatccggcagaagcaagagccgtacttgccactaggtcgttgcctggtgcgctcaacaggttaagtccgtgtgttgtgacacggtcgccatatttcagaacatcctccaccatcgagcttcccgacttctgtgtacatcccaatgatttctcctcaagcgtggaaatacctcccgccttgtttcccggtgaaggattttcatatattggctggtcgttgcggatgaagtagttcttgaagtcgtttatcatggccactgtgtcgtcgaatatctccttcgtgcggcaacggttcatgagcagtgtctcggctccgaacatttcaggtacctccgtgaggactgttgtcccaccctgggcaacaagatagtcagagaacaccccaagcatcggattggccgtgataccggacagtccatcagacccgccgcacttgagtcctatacgcagttttgacagggggacatcagtccgcttgtcttccctggctatggcatacatctcacggagaagtttcataccctcttctatctcatcatctactttctgagaaacaaggaaacggatcctttgggtatcatagtcacctataaactcacgaaaggcatcaggctggttgttctcacagccaagacctacgacaaggacagctccggcattgggatgaaggaccatgtcacgcaatatcttacgggtgttctcatggtcgtcacccaactgcgagcatccgtagttatgagggaaagatataatggagtcaaccccctcgcaacctgtttccttgcgaagctgctcggccaactggtttactattccgttcacgcaacccaccgtagggataatccatatctcattacgtatgccggcttctccgttagcacgcaaataccctttgaatgtatggttctcgttcgtgaatgtctgtttctcgaacttcggagtgtaagtgtatgtactcagaccggaaaggttcgtcttgacggttttctcgttcagcagatgtcctttcctgacttcctttacagcgtgcgatatggggaaaccgtattttatcaccatatcaccttctgcaaaatccttcagggcaatcttatgaccggcaggtatatcctccattaattctatggaattgccgttcacctctattacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagtatcggcgagaactgtcttcacaagattttctaccgagccatcgttccacaaacttgtaagcatcgccatgatttcctgtgcatcgttaggaactatctctacaccatcggcacgctttccacctttgtagtatactatgatggctgcaagaccgagtacaagtccttcaggaagcacacccttacgtttcagatattccttcactcctggaaggtcgcgtgtggcatacttagggaatgagttaagcatgattgatgttacctgatggtctacgaaaggattattgaaacgttccaggacatcatcggcaaacttcttgagttcctctttcggcaggttgagggtctccatcagctcgtcgaacatcacacgtttgatgaacttgcctatcacctcatgttggcatgcgtctctcacgatattgacgcccgaaaggaatgccaccggcgacaatacagtgtgaggaccgttcagcagagtaaccttgcgttcatgataaggctcctccgacgggacgaacagaacgttcagtcccgccttgtttgcaggaaattcttcggcaaccgattccggtgcttcgataacccacagatgaaaagcctcgccctgtacaactaaattgtcatcaaagtatagtttagtttttatgttgtctatgtctttacgagggaaacccggtacgatacggtccaccagtgtggcatatacaccacatgcagtttcaaaccatgacttgaactcttcgccaaggttccacaattcaatatactgatagattgtttccttcagtttgtgaccgttgaggaagataagctcgcatgggaagatgatgagtcctttcgacttgtcaccgttgaaatgtttgaatctgtgataaagcaactgtgtcagcttgcccggataagagcttgcaggagcatcctcaagcttgcacgacggatcgaagttgataccggcctcagtagtgttcgagattacgaatctcatatcaggctgttccgccagtgccatgaagtcattatactggctgtatggattcagcgcgcggctgatgacatcaatcattctgaatgagttcaccacctcgccattgttcagtccctgaagattgacatgatacagacagtcctgggcattgagggcatcaaccatacctttttctataggctgcaccacaacaacactgctgttgaaatctgtcttttcattcatattcgagataatccagtcgacaaacgcacgaaggaaattaccttcgccaaactgtatgatacgttccggacgtactgcctttactgcagtcttactatttaaagctttcattgtaatgccaaaaaattaaaattgataagattaaaattcaaccaacattctgaataccttacctggattttccgaccatttctgcagagcctcgcctgcctcttcaggtttcactacggcagagataagttcgttcatcgggcagttgccattctgaagataatgtatcacggcacggaaatcctcaggcattgcattgcgcgaaccgcgtatgtcgagttccttctggacaaaatattttgtctggaaagccacttcactcttggcatagccgatacatgccacacggcctgtgaaacctacaatgtcgatggcagtaacatatgtgataggactacccacagcctctatcaccacatcagccatatagccgtcagtaagttcccttactctttccaccacattttcagtcttcgaattgataaccatcgaagcacccaggcgttttgccagttcaagcttctcatcgtcaatatccaatgctattacccttgcgccacgaagcgatgctcttactatggcgccaagtccaatcattccgcaaccaatcacggccacagtatcaatgtcagttacctgagctctcgacacggcatggaaacctacgctcataggctcaatcagcgcacattccttatccgaaagaccggcagccggaataacctttgtccaagggaggacaaggaactcctgcatagaaccgttacgctgaacacccaaagtctcgttgtgttcgcaggcattcacacgtccgttgcggcatgaagcacactttccgcagttggtatatggatttactgtcacgttcattcccttctcgaaaccgacaggaacgccttcgcctatttcctctatcacagcacccacttcatgtcccgggatgacaggcatcttcaccataggatttcttcccaggtaagtattaaggtcggaaccacagaatccgacatatttgatacgaagtaaaatttctccggctccaagtgttggtttaactatatcagctacttgaacctttccggcttcagtaatttgtacagctttcataatctatgtatttatttaaatttgttattgtattattttgatgttgcattaattcaatgttgttttttctctatcttatatcctctccagccataatatgccgtaaagaagaaacatatcagaggtattacatatgccacctgatagaagtccgcgttatgattcatcacaaatgcggtgaactgagggatgcacgcattacctataatagccatcacaaggaatgccgaaccactctttgtgtcctcgccaaggtcgcgtagtgcaagtgagaactgggttggatacattatcgacatgaagaacgacactgcaagcatggcataaagtcctgtcataccaccgaacatgataattactccacacagtatgatatttactatagcgtatgtaagcagcatatcctgaggtctgaatttcgacattagcatagtacctatccatctgccgccaaggaaagccagcatatacagtccgaagaatgtggtcgcctcatcctccgacagacctgcatacatgcagcagtaaactaggaacaggctgttgatggctgtctgccctccgttatagaagaactgtgcgataactccccatctcaggtgtttgcgtttcaacactgcaaaattgataagcttgcccttctcgccgtgcgattcctccttgtcaatatcaggcaacttatacagtgcaaacaccacagcaagaataatcagcaggactgcaagaaccagataaggcatcttcatggagtctgtctccatctgaataaatccgtcccaacctccgggaaagtcggcaggcagagtctcgcgagtatagttctgtccggtaagtataagcttactcagaaacattgcggatatgaaagcaccaagaccgttgaacgactgtgcaagattcagtcttcttgaagccgtatcgtgtgtacccagagctgtcacatacggattggcagcagtttcgaggaagcacattcccgttgccatgatgaagaagattacaagatatgcccagtattcctttatctcggctgcagggaagaaaagcagaccaccgatggctgcaagaatgagaccgacaattatacccgacttatagctgaaacgtttcatgaacattgctatcggtatgggaaacaggaagtaggccagccaataggcagcttcagtgaacgaggcctcaaaagcattcagttcacaggttttcatcaactgcctgatcattgtaggcaatagattactgctgatagcccacatgaagaacaagctgaatatcagtaaaagcggtataaaatatttgtttttcattctgacatgtttttaatataaggtaactcaggcagattcttgaaaccgtaaaaggctttcgcgttctcgcccaagaaaagttttttgcttctctcttccaattcttttgatttaatcacaaagtcgtacgacatcttgtaggtaatggctgtgattgtgcgtggatagtcggaaccccacatcagtttctcgaagccaacaaggtcggcagcttcgttgatggctctgacagcgctgcggaacggatagaactcgtcattgaacagccaagtgataccgcccgactcaatcatcacattcttatgacgggcaagcattatctgcttcttccaatccggtttagtcaccataccgaaatgcccgatggcaatcttcaagtacggacattctgaaatgatttcttccatctcgcccacctggaggtctccctctgccatatctatggaaagaatcacccccttgtcttccattagatgaaacatcctcatcatctcgtccgagttgagcatcaccctaccgtccttcagttgcaggcggtgtcccggaatctttatggccttgaaccctttgtctataagttcaaccgcctggttatagaaacccggttttctgaattcacacataccacacacgaagaacctgtccggatatttcgtcatcacctccatcagatagtcattctgaatgccgtcgatatactcctgtgtgacaacagccgcgccaatcagggcataattcatattagccaggaaaacctcagccgtgtttcttccgtcaatcataaagggggggggagcatttgtctcacctcccccataaacaatgattgaccgttctctgtagtcttgattttcaggccatctacttcagtgtcctgataaagccacagatgcgaatgggcgtcaattattgtataatccatagaaacagtatttatgaatttgcccaacttactctttgctgatcgcctattatctccttaaccttttccacaaggctccagtctatcggttcctcaatgtattttatgttctgaagcacagactctgttcttgccgagctgaacaatgttgtaggtattctcggattgcttacagagaactgcaccgcaagtttctcgatagggtatccctgttcagcacaatacttggcagcctttgcacacacctcaatcaatggttttggagccggatgccattcaggaacacctctatgtgtgagaagtcccataccgaacggcgaagcgtttatcactcccacaccattttcgtcaaaatagtcgaggaagtccaccagcttgtcgtcgttcaatgaatagtgacagaagttaagcaccgcctctactgtacccggagcggcatggtcgataatccatttcaggttttcgagctgcaggtcggtgatacccacgtggcccaccacgcctttcttcttcagttccaccagagcaggcaatgtctcgttcaccacctggttcatatccgagaactcaacgtcgtgaacgttgataaggtcgatatagtcgatgttcagacgttccatactttcgtaaacactctcctgagcgcgtttgtccgagtagtcccacgtattcacaccgtccttgccatagcgtcccacctttgtagaaaggatgaacgattctcttggcaattccttcagagccttacccaatacggtttcggctttataatgtccgtaatatggagaaacatcaataaagttcagtccgcgttccactgctgtaaaaacagactgtatagcgtcactttctttgatagaatgaaaaactccgcccaatgaagatgcgccataactcaatacaggaaccttaagtcctgtctttcccaattcacgatattccatttttgataaataatttaaaggttaatattttttactctgtttattcttattcatacagatagaacatacgttccatcatcttccatttctcgtccgatgtggccccctcggcacactgctggaatttggctacgtattcttcccattcggcctgacgcggcagagtggcaagctttgccatagctgtatcccagtcaaaatccagaggtgtttccactatcataaagagttttgaccccaatatgtatatttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatgaagtatccatcaaaacaatagaggagattttcaaaaaagaaagaggggatattataccccctctttttcgacatttttacccctcataaaggagataaaaagtcaccccaaactctataaaaaatcaaaacagattgaactgcattcctgtgtagaaaaatccctggttggatttcggattccaatacgtcatcaccgtcaacgggatttcatattccataatccgaagtttataaatcacattcagggacacctgagtaattcctgccgattcggcatacatggttctgttcaccatttccccgctttcatttcttgaatttctcaatgcgaaagctgttccaataccaggaccgacccttagcttttcgttctgatagatggtatagcccacatatacgaaactggagtagatgttcttgctgttgtccagatccctgtcgcgaccgtaaacaagtgtagagaagctcaactccagcggaaatttcctgtcgcccgtataattgaccatgagatcaacgaaacgtccagtttcatcaggcttatagttgaagaactccttattattatatgtagccccgggcgagaaattatatgtatctatagcctttatctgaaacctgccatgagtatatgctatatactggctcagctccttataactccccctggtgttcgatccgccaaggaaaccggcggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaa

SEQ ID NO: 74 - DNA, 4533 bp, Artificial Sequence
  Description of Artificial Sequence: Synthetic polynucleotide
actagagatctatgtgaggatcctaactcgagatcgagactgctatgacttgagaccggctattacgagcgcttaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggttcctagctgattagaaggccatcctgacggatggcctttttttttgataataagcggatgaatggcagaaattcgacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaacgtaccggtctcagtagggagagctgtatgtgggtag

SEQ ID NO: 75 - DNA, 17148 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctgagctgtcaccggatgtgctttccggtctgatgagtccgtgaggacgaaacagcctctacaaataattttgtttaatccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcaggttcaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactgcccgacgaacggactaatcctgacgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgctctgggtctgacggccatcaagggtagtgagactagctgattagaaggccatcctgacggatggccttttttttgactgggtgttccgatacactcaatttgtgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctagctgattagaaggccatcctgacggatggccttttttttgacttagtttcaattttacattccaggaagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagttatatacattcatgtccatttatgtaaaaaatcctgctgaccttgtttatgtcttgtcagtcaccatttgcaaaaccatatttgaccctcaaagaggctgaatttgataagcaacttgctacatactcataataaggagctaaatagaacacgaatgggaaatactcaaatgccaaactaaagaagatattggccaaaataaacgctataccgagagagaaacttgatttttcaacttcctaaaacagtgttgttcaaacatttctacttatttgtacttaccagttgaacctacgtttccctaataaaatgtctatggtaaaaagttaaaaaatcctcctacttttgttagatatatttttttgtgtaattttgtaatcgttatgcggcagtaataatatacatattaatacgagttaggaatcctgtagttctcatatgctacgaggaggtattaaaaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggctgtgtggataatggtgacaccataacggactctatggatatagagaaacgtagaggaattactgttcgggcttctacgacatctattatctggaatggtgtgaaatgcaatatcattgacactccgggacacatggattttattgcggaagtggagcggacattcaaaatgcttgatggagcagtcctcatcttatccgcaaaggaaggcatacaagcgcagacaaagttgctgttcaatactttacagaagctgcaaatcccgacaattatatttatcaataagattgaccgagccggtgtgaatttggagcgtttgtatctggatataaaagcaaatctgtctcaagatgtcctgtttatgcaaaatgttgtcgatggatcggtttatccggtttgctcccaaacatatataaaggaagaatacaaagaatttgtatgcaaccatgacgacaatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatcacttcttttatacttcctccggcatcggtttcaaacagactttcatcttatctttataagatagagcatgaccccaaaggacataaaagaagttttctaaaaataattgacggaagtctgagacttcgagatgttgtaagaatcaacgattcggaaaaattcatcaagattaaaaatctaaaaactatcaatcagggcagagagataaatgttgatgaagtgggcgccaatgatatcgcgattgtagaggatatggatgattttcgaatcggaaattatttaggtgctgaaccttgtttgattcaaggattatcgcatcagcatcccgctctcaaatcctccgtccggccagacaggcccgaagagagaagcaaggtgatatccgctctgaatacattgtggattgaagatccgtctttgtccttttccataaactcatatagtgatgaattggaaatctcgttatatggtttaacccaaaaggaaatcatacagacattgctggaagaacgattttccgtaaaggtccattttgatgagatcaagactatatacaaagaacgacctgtaaaaaaggtcaataagattattcagatcgaagtgccgcccaacccttattgggccacaatagggctgactcttgaacccttaccgttagggacagggttgcaaatcgaaagtgacatctcctatggttatctgaaccattcttttcaaaatgccgtttttgaagggattcgtatgtcttgccaatccgggttacatggatgggaagtgactgatctgaaagtaacttttactcaagccgagtattatagcccggtaagtacaccagctgatttcagacagctgaccccttatgtctttaggctggccttgcaacagtcaggtgtggacattctcgaaccgatgctctattttgagttgcagataccccaagcggcaagttccaaagctattacagatttgcaaaaaatgatgtctgagattgaagatatcagttgcaataatgagtggtgtcatattaaagggaaagttccattaaatacaagtaaagactatgcatcagaagtaagttcatacactaagggcttaggcatttttatggttaagccatgcgggtatcaaataacaaaaggcggttattctgataatatccgcatgaacgaaaaagataaacttttattcatgttccaaaaatcaatgtcatcaaaataaccacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 76 - DNA, 18943 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctgagctgtcaccggatgtgctttccggtctgatgagtccgtgaggacgaaacagcctctacaaataattttgtttaatccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcaggttcaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactgcccgacgaacggactaatcctgacgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgctctgggtctgacggccatcaagggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctagctgattagaaggccatcctgacggatggccttttttttgactgggtgttccgatacactcaatttgtgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctagctgattagaaggccatcctgacggatggccttttttttgacttagtttcaattttacattccaggaagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagttatatacattcatgtccatttatgtaaaaaatcctgctgaccttgtttatgtcttgtcagtcaccatttgcaaaaccatatttgaccctcaaagaggctgaatttgataagcaacttgctacatactcataataaggagctaaatagaacacgaatgggaaatactcaaatgccaaactaaagaagatattggccaaaataaacgctataccgagagagaaacttgatttttcaacttcctaaaacagtgttgttcaaacatttctacttatttgtacttaccagttgaacctacgtttccctaataaaatgtctatggtaaaaagttaaaaaatcctcctacttttgttagatatatttttttgtgtaattttgtaatcgttatgcggcagtaataatatacatattaatacgagttaggaatcctgtagttctcatatgctacgaggaggtattaaaaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggctgtgtggataatggtgacaccataacggactctatggatatagagaaacgtagaggaattactgttcgggcttctacgacatctattatctggaatggtgtgaaatgcaatatcattgacactccgggacacatggattttattgcggaagtggagcggacattcaaaatgcttgatggagcagtcctcatcttatccgcaaaggaaggcatacaagcgcagacaaagttgctgttcaatactttacagaagctgcaaatcccgacaattatatttatcaataagattgaccgagccggtgtgaatttggagcgtttgtatctggatataaaagcaaatctgtctcaagatgtcctgtttatgcaaaatgttgtcgatggatcggtttatccggtttgctcccaaacatatataaaggaagaatacaaagaatttgtatgcaaccatgacgacaatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatcacttcttttatacttcctccggcatcggtttcaaacagactttcatcttatctttataagatagagcatgaccccaaaggacataaaagaagttttctaaaaataattgacggaagtctgagacttcgagatgttgtaagaatcaacgattcggaaaaattcatcaagattaaaaatctaaaaactatcaatcagggcagagagataaatgttgatgaagtgggcgccaatgatatcgcgattgtagaggatatggatgattttcgaatcggaaattatttaggtgctgaaccttgtttgattcaaggattatcgcatcagcatcccgctctcaaatcctccgtccggccagacaggcccgaagagagaagcaaggtgatatccgctctgaatacattgtggattgaagatccgtctttgtccttttccataaactcatatagtgatgaattggaaatctcgttatatggtttaacccaaaaggaaatcatacagacattgctggaagaacgattttccgtaaaggtccattttgatgagatcaagactatatacaaagaacgacctgtaaaaaaggtcaataagattattcagatcgaagtgccgcccaacccttattgggccacaatagggctgactcttgaacccttaccgttagggacagggttgcaaatcgaaagtgacatctcctatggttatctgaaccattcttttcaaaatgccgtttttgaagggattcgtatgtcttgccaatccgggttacatggatgggaagtgactgatctgaaagtaacttttactcaagccgagtattatagcccggtaagtacaccagctgatttcagacagctgaccccttatgtctttaggctggccttgcaacagtcaggtgtggacattctcgaaccgatgctctattttgagttgcagataccccaagcggcaagttccaaagctattacagatttgcaaaaaatgatgtctgagattgaagatatcagttgcaataatgagtggtgtcatattaaagggaaagttccattaaatacaagtaaagactatgcatcagaagtaagttcatacactaagggcttaggcatttttatggttaagccatgcgggtatcaaataacaaaaggcggttattctgataatatccgcatgaacgaaaaagataaacttttattcatgttccaaaaatcaatgtcatcaaaataaccacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 77 - DNA, 18943 bp, Artificial Sequence
  Description of Artificial Sequence: Synthetic polynucleotide
ggagagctgtatgtgggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctagctgattagaaggccatcctgacggatggccttttttttgactggtaagccaatctagggcctcgtctgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctgagctgtcaccggatgtgctttccggtctgatgagtccgtgaggacgaaacagcctctacaaataattttgtttaatccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcaggttcaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactgcgttcctggcgtggtgctcgcatagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactgcccgacgaacggactaatcctgacgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatagggttcctagctgattagaaggccatcctgacggatggccttttttttgactgctctgggtctgacggccatcaagggtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctagctgattagaaggccatcctgacggatggccttttttttgactgggtgttccgatacactcaatttgtgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttcaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctagctgattagaaggccatcctgacggatggccttttttttgacttagtttcaattttacattccaggaagtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggatcacacaacatttaaaaaataacattatgaaagcactcgaaaagagattcaaaggtaatattaacaataatttattttaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactgctatgactaaacggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagttatatacattcatgtccatttatgtaaaaaatcctgctgaccttgtttatgtcttgtcagtcaccatttgcaaaaccatatttgaccctcaaagaggctgaatttgataagcaacttgctacatactcataataaggagctaaatagaacacgaatgggaaatactcaaatgccaaactaaagaagatattggccaaaataaacgctataccgagagagaaacttgatttttcaacttcctaaaacagtgttgttcaaacatttctacttatttgtacttaccagttgaacctacgtttccctaataaaatgtctatggtaaaaagttaaaaaatcctcctacttttgttagatatatttttttgtgtaattttgtaatcgttatgcggcagtaataatatacatattaatacgagttaggaatcctgtagttctcatatgctacgaggaggtattaaaaggtgcgtttcgacaatgcatctattgtagtatattattgcttaatccaaatgaatattataaatttaggaattcttgctcacattgatgcaggaaaaacttccgtaaccgagaatctgctgtttgccagtggagcaacggaaaagtgcggctgtgtggataatggtgacaccataacggactctatggatatagagaaacgtagaggaattactgttcgggcttctacgacatctattatctggaatggtgtgaaatgcaatatcattgacactccgggacacatggattttattgcggaagtggagcggacattcaaaatgcttgatggagcagtcctcatcttatccgcaaaggaaggcatacaagcgcagacaaagttgctgttcaatactttacagaagctgcaaatcccgacaattatatttatcaataagattgaccgagccggtgtgaatttggagcgtttgtatctggatataaaagcaaatctgtctcaagatgtcctgtttatgcaaaatgttgtcgatggatcggtttatccggtttgctcccaaacatatataaaggaagaatacaaagaatttgtatgcaaccatgacgacaatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatcacttcttttatacttcctccggcatcggtttcaaacagactttcatcttatctttataagatagagcatgaccccaaaggacataaaagaagttttctaaaaataattgacggaagtctgagacttcgagatgttgtaagaatcaacgattcggaaaaattcatcaagattaaaaatctaaaaactatcaatcagggcagagagataaatgttgatgaagtgggcgccaatgatatcgcgattgtagaggatatggatgattttcgaatcggaaattatttaggtgctgaaccttgtttgattcaaggattatcgcatcagcatcccgctctcaaatcctccgtccggccagacaggcccgaagagagaagcaaggtgatatccgctctgaatacattgtggattgaagatccgtctttgtccttttccataaactcatatagtgatgaattggaaatctcgttatatggtttaacccaaaaggaaatcatacagacattgctggaagaacgattttccgtaaaggtccattttgatgagatcaagactatatacaaagaacgacctgtaaaaaaggtcaataagattattcagatcgaagtgccgcccaacccttattgggccacaatagggctgactcttgaacccttaccgttagggacagggttgcaaatcgaaagtgacatctcctatggttatctgaaccattcttttcaaaatgccgtttttgaagggattcgtatgtcttgccaatccgggttacatggatgggaagtgactgatctgaaagtaacttttactcaagccgagtattatagcccggtaagtacaccagctgatttcagacagctgaccccttatgtctttaggctggccttgcaacagtcaggtgtggacattctcgaaccgatgctctattttgagttgcagataccccaagcggcaagttccaaagctattacagatttgcaaaaaatgatgtctgagattgaagatatcagttgcaataatgagtggtgtcatattaaagggaaagttccattaaatacaagtaaagactatgcatcagaagtaagttcatacactaagggcttaggcatttttatggttaagccatgcgggtatcaaataacaaaaggcggttattctgataatatccgcatgaacgaaaaagataaacttttattcatgttccaaaaatcaatgtcatcaaaataaccacgagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagccgcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgctcaagtag

SEQ ID NO: 78 - DNA, 82 bp, Artificial Sequence
  Description of Artificial Sequence: Synthetic oligonucleotide
gatcacacaacatttaaaaaataacattatgaaagcactcgaaaagagattcaaaggtaatattaacaataatttattttca

SEQ ID NO: 79 - DNA, 537 bp, Artificial Sequence
  Description of Artificial Sequence: Synthetic polynucleotide
tccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggca

SEQ ID NO: 80 - DNA, 164 bp, Artificial Sequence
  Description of Artificial Sequence: Synthetic polynucleotide
gataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtag

SEQ ID NO: 81 - DNA, 16286 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaacctgcctggcatcaactacctaaattaattatcaccccaaattaataacataaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaacgacctggcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaattcccctggcatcatctacctttattaatcaacaatccaaattattaataaaaaaaatttaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaaaaccctggcatcatctacctatattaatcatcaacccaattttcatatgtataaaattaacaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 82 - DNA, 16286 bp, Artificial Sequence; identical to SEQ ID NO: 81
  Description of Artificial Sequence: Synthetic polynucleotide

SEQ ID NO: 83 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcatctaccttcattattaaacaaaccaaattaatatcataaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaacctgcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaacgacctggcatcatctacctttattaatcaacaatccaaattattaataaaaaaaatttaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaagggtcctggcatcaactacctacattaataaccaacccaaatgcctaatcaataaatattataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaattcccctggcatccccaaaaaattaattcattttctcttttcaacaatttaaaaaaaattaaaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaaatgcctggcatctaaactaaaatacaataaccaaaaatcatctatgcgtaaaaaaaattataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctaaaaaccctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 84 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcatctaccttcattattaaacaaaccaaattaatatcataaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaacctgcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaacgacctggcatcatctacctttattaatcaacaatccaaattattaataaaaaaaatttaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaagggtcctggcatcacctaaaaattataaataaattaataaaccttttaacataaaaattaataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaattcccctggcatccccaaaaaattaattcattttctcttttcaacaatttaaaaaaaattaaaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaaatgcctggcatctaaactaaaatacaataaccaaaaatcatctatgcgtaaaaaaaattataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctaaaaaccctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 85 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcacctaaaaattataaataaattaataaaccacaatactaaaaatttaataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaacctgcctggcatcatctacctatattaatcatcaacccaattttcatatgtataaaattaacaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctaaacgacctggcatcaactacctttattattcaacaaaccaatttaacatattaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaagggtcctggcatctaaactaaaatacaataaccaaaaatcatgtttaacaaataaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctaattcccctggcatcatctacctatattactaaacaaaccaattataataattttaaaaataaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaaatgcctggcatcatctacctaaattaataaacaacccatttataaaccctttaaaattaacaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaaaaccctggcatcaactacctaaattaattatcaccccaaattaataacataaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 86 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaacctgcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaacgacctggcatcaactacctttattattcaacaaaccaatttaacatattaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaagggtcctggcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaattcccctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctaaaatgcctggcatcaactacctaaattaattatcaccccaaattaataacataaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaaaaccctggcatctaaactaaaatacaataaccaaaaatcattacaaatgaaaaaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 87 - DNA, 17881 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaacctgcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaacgacctggcatcaactacctttattattcaacaaaccaatttaacatattaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaattcccctggcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaaatgcctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctaaaaaccctggcatctaaactaaaatacaataaccaaaaatcattacaaatgaaaaaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 88 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcatctaccttcattattaatcattccaattgtatcacttaaaaatataaaaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaacctgcctggcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaacgacctggcatcatctaccttcattattaaacaaaccaaattaatatcataaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaagggtcctggcatccccaaaaaattaattcattttctcttttccctaacccttaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaattcccctggcatctaaactaaaatacaataaccaaaaatcatactacatgtataaaattaaaaaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctaaaatgcctggcatcaactacctcaattaataatcaaaccatctgaacaatgaataaatttaaaaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctaaaaaccctggcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 89 - DNA, 19662 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcatctaccttcattattaatcattccaattgtatcacttaaaaatataaaaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaacctgcctggcatctacccctaacaacccataaatttaactttaaaaaatttttaaatataataaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaaacgacctggcatcatctacctatattactaaacaaaccaattataataattttaaaaataaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaagggtcctggcatctaaactaaaatacaataaccaaaaatcatctatgcgtaaaaaaaattataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctgaggttcctaattcccctggcatccccaaaaaattaattcattttctcttttcaacaatttaaaaaaaattaaaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaaatgcctggcatcaactacctcaattaataatcaaaccatctgaacaatgaataaatttaaaaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctaaaaaccctggcatcatctacctatattattcatcaaaccatttgatccaacattaaatattaaaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 90 - DNA, 16286 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaacctgcctggcatcaactacctaaattaattatcaccccaaattaataacataaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaataaggttcctaaacgacctggcatcaactacctacattaataaccaacccaaatgcctaatcaataaatattataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaattcccctggcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaaaaccctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 91 - DNA, 16262 bp, Artificial Sequence
  Description of Artificial Sequence: Synthetic polynucleotide
ggagagctgtatgtggggtggaagaagctatcgtaaaaatgctggagcagcttgatcctcattctacctattctgatccggaggaagtgaagagaatgaacgagccgttgcagggaaacttcgaaggtatcggtatacagtttaatatggcggaggacactttgctggtgatacagcctgtatcgggcggaccgtccgaaaaagtcggtattctggccggtgatcgtatcgtcatggtggaagatacgctgatagccggtgtaaagatgagtaccgaggatattatgcgtcgcctccgtggtcctaaagattcaaaagtgaatctgaaaatacttcgccgaggggtgaaggaactgctcccctttacggtgaaaagggataaaatacctgtttacagcttggatgcttcctatatgattaaagataagatcggttatattcgtatcaaccgttttgccgccactacccatgaggagttcaagaaagcgctgaccgggttgcagaagaaaggaatgaaagacttgattcttgatttgcagggcaatggcggggggtatttgaatgctgctatcgatattgccaatgaatttttgggtaaaaaggaactgattgtctatacggagggccgtcgtaatcctcgtagcgagttttttgccaaaggtacgggcgagtttcagaacggtcgtctgatggtattggttgatgaattttcggcttctgccagtgagattgtgaccggagctgttcaggattgggacagaggcgttgtggtaggccgtcgcagttttggtaaaggcttggtgcagcgtcccattgatttgccggacggttcgatgatccgtctgacggtggcccgctattatacgcctgccggacgttgtatccagaaaccttacgagagcattgaaaagtataatgaagacctgatagaccgttataataaaggagaaatgatgagtgaagacagcatccactttccggattcactgaagttcaagactcataggttggcccgtacggtatatggtggcggagggatcatgcccgattattttgtgccgattgatacgactctctatactaaataccatcgtcagttgcgtgataaaggagcattgatgaaagctcatttccattttattgatgcccatcgtaaagaatggctgggcaaatacaagactttcaatgagttctacaaacgttttgaagtgactccggatatgttgacacaactggttgctaccggcaaggagatgggagtggaatataatgaagaagagtatcaaaaggccctgcctctgctgaggttgcagatgaaagcattgatagcccgtgatttatgggatatgaatgaatattatcacgtcattaatgacgcgaatgaaagtatcaggaaagcgctggaactgttggagcaaccggactttgaggggctgctgttgaaaaagcgatagtcaagactttatattaactgcaggggcgcatagttgcactcctgcagttgtctgaaaaacttgtaggataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtagcctggcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacattaaggttcctaacctgcctggcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatctgaggttcctaaacgacctggcatcaactacctttattattcaacaaaccaatttaacatattaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactgtaaggttcctaattcccctggcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataaggttcctaaaaaccctggcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttgtagggttcctagctgattagaaggccatcctgacggatggccttttttttgactctgttgtgtcttcttttaggtgtggaataattttccaaccatcactttatctgtctcccgaacagcaccttattcagccatcggttcacatacacgttcacgaaagcacatcctactccgatagcggctcctgccactacatcactgggatagtgcaccccttggttcatccgggcaaaccctactccgcaagcccatacggctgaaggggcgataacataccacttaggataagtgatggagagtgaggtggctaaagaaaaagctgccgcagtgtgtcctgaagggaatgacggactatcggcatccggtgctccgtatgcatgaatcttatccggatactttacaaaaggccggtcacgacctattatatgtttggcggcgtatgtaatccccactgcttcaatcacactggttcctatgtaaatggcatctttcagcatcggctggtctttctttatcaatgcatagagtcccatggctgtaggtattcctacgggtagaatcactccgctagcggacaatccgcggctcagtccgtgtacatcccatcggttgatggttttcaacgtgttgatgtctatattctgtgcgctgaggctgaatgtaaaacaggctgtcagtataagaaaaataatcctttggcgtttcatttagtttggcatttgttcagtgcaaagataggaaaataatgtaattcgcatttacccttccccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccgggctggctgctctgtttgtaattcacatcatctacgctttctggttgaccatgcagaaccgtgcagctcgcggtagcgaacgttatgcagtgaacgttaaacctaaaactgtggaatgggcatctcagaacatgcttgtcctgggtattgtcgttattgccggattggctcttcattttgccaatttctggtacaaaatgcagtttgccgaaattatcggtgttcatgatttgggcgcattcggtcctacagacggtgccgcttacattcgtgaaacattcggatgccctgtatttacagtgctttacctcatttggttagcagctttgtggttccacctgactcacggattctggagtgctttgcagactttgggctggagcaataaaatctggttcgagcgttggaagactattggtaacatctactctactttggtagttcttggttttgcagcagtagtcgttatctacttcgctatgactggcgcgcctgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagagcctacgttccgaatacggtcaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctacagtcgctcggcgatcgaaggcttcggaaaaaaaaggccatccgtcaggatggccttcgcattaatatgccgcttcgaattcttttaggaagcgtgtatcgttttcagagaacatacggaggtctttcacctgatatttcaggtttgtgatacgctcgatacccataccgagtccataaccgctgtatattttgctgtctataccatttgattcaagtacgttcgggtctaccataccgcaaccgaggatttctacccagccggtgtgtttacagaacggacatcctttaccgccgcagatattacagctgatatccatttccgcacttggttcagcaaacgggaagtaagacggacgcagacggatctttgtatcagcaccgaacatttctttggcaaagagcagcaatacctgcttcaagtcggtgaatgatacgtttttatctacatacagcgcttctacctgatggaagaaacagtgtgcgcgatagctgatagcttcgttacgatatacacgtcccggacagatgatgcggataggaggctgtgaagtttccatcacacgagtctgtacagaagaagtatgtgtacgcaatactacgtccgggtgagcttcgataaagaaagtgtcctgcatatcgcgtgccggatgatcttcggcaaagttcagtgccgagaacacgtgccagtcatcttcaatttccggaccttcggcaatgctgaatcccagacgggcaaagatatcaatgatttcgttctttacaatggtgagcgggtggcgtgtaccgagttctacaggataagccgaacgcgtcaaatccagtccgtcacaatcgttgtcctgactttcaaacatttctttcagcgcgttgattttgtcctgcgcttttgttttcagttcattcagtctcatgccgacttcttttttctgttcggcagctacattacggaaatctgccattaagtcgttaatggctcccttcttacttaggtatttgatgcggagagcttcgagttcttcggcattggaggcgtgtaaggcttccacctctttcagaagttgttcaatcttagctatcattttttaatatttttagcggccccgttaaacaaaattatttgtagaggctgtttcgtcctcacggactcatcagaccggaaagcacatccggtgacagctcaggctactttgtttctttcgacactgcaaatataagaacattatttgaaagttcaagtgaaactttaaattttaacaatagattaaccattgcaaacaaaacaaaaaaaaggtagcccaattgtaaaacgaaaggcccagtctttcgactgagcctttcgttttatcctaggatcagctgtacgtactcgcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcttttaaggtttaacggttgtggacaacaagccagggatgtaacgcactgagaagcccttagagcctctcaaagcaattttgagtgacacaggaacacttaacggctgacatggggcggccgcgtag

SEQ ID NO: 92 - DNA, 19662 bp, Artificial Sequence; identical to SEQ ID NO: 84
  Description of Artificial Sequence: Synthetic polynucleotide

SEQ ID NO: 93 - DNA, 19662 bp, Artificial Sequence; identical to SEQ ID NO: 86
  Description of Artificial Sequence: Synthetic polynucleotide

SEQ ID NO: 94 - DNA, 17881 bp, Artificial Sequence; identical to SEQ ID NO: 87
  Description of Artificial Sequence: Synthetic polynucleotide

SEQ ID NO: 95 - DNA, 19662 bp, Artificial Sequence; identical to SEQ ID NO: 88
  Description of Artificial Sequence: Synthetic polynucleotide

SEQ ID NO: 96 - DNA, 1599 bp, Artificial Sequence
  Description of Artificial Sequence: Synthetic polynucleotide
gcatctaaactaaaatacaataaccaaaaatcattacaaatgaaaaaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 97 - DNA, 1599 bp, Artificial Sequence
  Description of Artificial Sequence: Synthetic polynucleotide
gcatctaaactaaaatacaataaccaaaaatcatgtttaacaaataaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 98 - DNA, 1599 bp, Artificial Sequence
  Description of Artificial Sequence: Synthetic polynucleotide
gcatctaaactaaaatacaataaccaaaaatcatctatgcgtaaaaaaaattataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 99 - DNA, 1599 bp, Artificial Sequence
  Description of Artificial Sequence: Synthetic polynucleotide
gcatctaaactaaaatacaataaccaaaaatcatactacatgtataaaattaaaaaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 100 - DNA, 1599 bp, Artificial Sequence
  Description of Artificial Sequence: Synthetic polynucleotide
gcatctaaactaaaatacaataaccaaaaatcattttcacaatataaaaataacaaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 101 - DNA, 1599 bp, Artificial Sequence
  Description of Artificial Sequence: Synthetic polynucleotide
gcatcatctacctcaattattcaccattccatctgtctagccaaaaaatttaaaaaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 102 - DNA, 1599 bp, Artificial Sequence
  Description of Artificial Sequence: Synthetic polynucleotide
gcatcatctacctaaattactcatcatcccattttagtcagcttaaaatattataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 103 - DNA, 1599 bp, Artificial Sequence
  Description of Artificial Sequence: Synthetic polynucleotide
gcatcatctacctatattatttatcattccatatcatgcgtgaataaaaataataaaatggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctggctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgattgttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgaaacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccc

SEQ ID NO: 104 - DNA, 1686 bp, Artificial Sequence
  Description of Artificial Sequence: Synthetic polynucleotide
gcatcatctacctatattaatcatcaacccaattttcatatgtataaaattaacaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 105 - DNA, 1686 bp, Artificial Sequence
  Description of Artificial Sequence: Synthetic polynucleotide
gcatcttttccataacaaaaattaaacctcctccatatgaaaaataaaaattataaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 106 - DNA, 1686 bp, Artificial Sequence
  Description of Artificial Sequence: Synthetic polynucleotide
gcatcaactacctcaattaataatcaaaccatctgaacaatgaataaatttaaaaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 107 - DNA, 1686 bp, Artificial Sequence
  Description of Artificial Sequence: Synthetic polynucleotide
gcatcttttccataacaaaaattaaacctcctccatatgagatataaaattaacaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 108 - DNA, 1686 bp, Artificial Sequence
  Description of Artificial Sequence: Synthetic polynucleotide
gcatcaactaccttaattattcatcaaaccatataacatactaaaaaaaataacaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 109 - DNA, 1686 bp, Artificial Sequence
  Description of Artificial Sequence: Synthetic polynucleotide
gcatcatctacctatattactaatcattccaattaattaccttataaaattaagaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 110 - DNA, 1686 bp, Artificial Sequence
  Description of Artificial Sequence: Synthetic polynucleotide
gcatcttttccataacaaaaattaaacctcctcccccccacgtttaaaattaaaaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 111 - DNA, 1686 bp, Artificial Sequence
  Description of Artificial Sequence: Synthetic polynucleotide
gcatcaactaccttcattacttaacaatccacctgttgtgagtaaaaatataagaaaatgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 112 - DNA, 1761 bp, Artificial Sequence
  Description of Artificial Sequence: Synthetic polynucleotide
gcatccccaaaaaattaattcattttctcttttccctaacccttaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 113 - DNA, 1761 bp, Artificial Sequence
  Description of Artificial Sequence: Synthetic polynucleotide
gcatcaactacctaaattaattatcaccccaaattaataacataaaaatataataaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 114 - DNA, 1761 bp, Artificial Sequence; identical to SEQ ID NO: 113
  Description of Artificial Sequence: Synthetic polynucleotide

SEQ ID NO: 115 - DNA, 1761 bp, Artificial Sequence
  Description of Artificial Sequence: Synthetic polynucleotide
gcatccccaaaaaattaattcattttctcttttcaacaatttaaaaaaaattaaaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 116 - DNA, 1761 bp, Artificial Sequence
  Description of Artificial Sequence: Synthetic polynucleotide
gcatccccaaaaaattaattcattttctcttttcgatcctataaaaaatataacaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 117 - DNA, 1761 bp, Artificial Sequence
  Description of Artificial Sequence: Synthetic polynucleotide
gcatcatctacctttattattaatcaatccatctcagtaagtttaaaatataacaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 118 - DNA, 1761 bp, Artificial Sequence
  Description of Artificial Sequence: Synthetic polynucleotide
gcatcaactacctctattaataatcaatccacatcttgatcgtaaaaaatttaaaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 119 - DNA, 1761 bp, Artificial Sequence
  Description of Artificial Sequence: Synthetic polynucleotide
gcatcacctacctaaattactaaacaaaccacctgcatttgttttaaaaattacaaaatgagtaacgacgacaatgtagagttgactgatggctttcatgttttgatcgatgccctgaaaatgaatgacatcgataccatgtatggtgttgtcggcattcctatcacgaacctggctcgtatgtggcaagatgacggtcagcgtttttacagcttccgtcacgaacaacacgcaggttatgcagcttctatcgccggttacatcgaaggaaaacctggcgtttgcttgaccgtttccgcccctggcttcctgaacggcgtgacttccctggctcatgcaaccaccaactgcttcccaatgatcctgttgagcggttccagtgaacgtgaaatcgtcgatttgcaacagggcgattacgaagaaatggatcagatgaatgttgcacgtccacactgcaaagcttctttccgtatcaacagcatcaaagacattccaatcggtatcgctcgtgcagttcgcaccgctgtatccggacgtccaggtggtgtttacgttgacttgccagcaaaactgttcggtcagaccatttctgtagaagaagctaacaaactgctcttcaaaccaatcgatccagctccggcacagattcctgctgaagatgctatcgctcgcgctgctgacctgatcaagaacgccaaacgtccagttatcatgctgggtaaaggcgctgcatacgcacaatgcgacgacgaaatccgcgcactggttgaagaaaccggcatcccattcctgccaatgggtatggctaaaggcctgctgcctgacaaccatccacaatccgctgctgcaacccgtgctttcgcactggcacagtgtgacgtttgcgtactgatcggcgctcgtctgaactggctgatgcagcacggtaaaggcaaaacctggggcgacgaactgaagaaatacgttcagatcgacatccaggctaacgaaatggacagcaaccagcctatcgctgcaccagttgttggtgacatcaagtccgccgtttccctgctccgcaaagcactgaaaggcgctccaaaagctgacgctgaatggaccggcgctctgaaagccaaagttgacggcaacaaagccaaactggctggcaagatgactgccgaaaccccatccggaatgatgaactactccaattccctgggcgttgttcgtgacttcatgctggcaaatccggatatttccctggttaacgaaggcgctaatgcactcgacaacactcgtatgattgttgacatgctgaaaccacgcaaacgtcttgactccggtacctggggtgttatgggtattggtatgggctactgcgttgctgcagctgctgttaccggcaaaccggttatcgctgttgaaggcgatagcgcattcggtttctccggtatggaactggaaaccatctgccgttacaacctgccagttaccgttatcatcatgaacaatggtggtatctataaaggtaacgaagcagatccacaaccaggcgttatctcctgtacccgtctgacccgtggtcgttacgacatgatgatggaagcatttggcggtaaaggttatgttgccaatactccagcagaactgaaagctgctctggaagaagctgttgcttccggcaaaccatgcctgatcaacgcgatgatcgatccagacgctggtgtcgaatctggccgtatcaagagcctgaacgttgtaagtaaagttggcaagaaa

SEQ ID NO: 120 - DNA, 1737 bp, Artificial Sequence
  Description of Artificial Sequence: Synthetic polynucleotide
gcatcaactacctaaattaatcatcaaaccaactagaatatgaaaaaaaataaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 121 - DNA, 1737 bp, Artificial Sequence
  Description of Artificial Sequence: Synthetic polynucleotide
gcatcaactacctcaattaataaacaaaccaactgtccaatgtataaaattaaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 122 - DNA, 1737 bp, Artificial Sequence
  Description of Artificial Sequence: Synthetic polynucleotide
gcatcaactacctcaattactaaacaatccacattattaatataaaaatataaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 123 - DNA, 1736 bp, Artificial Sequence
  Description of Artificial Sequence: Synthetic polynucleotide
gcatcaacacctaaattaattaacacaccatatattaaaccataaaaaataagaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 124 - DNA, 1737 bp, Artificial Sequence
  Description of Artificial Sequence: Synthetic polynucleotide
gcatcttctacccatattccccctaatcccatctgttatattattaaatttaataaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 125 - DNA, 1737 bp, Artificial Sequence
  Description of Artificial Sequence: Synthetic polynucleotide
gcatcatctacctacattatttaacaaaccacatttaaaaggaaaaaatattaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 126 - DNA, 1737 bp, Artificial Sequence
  Description of Artificial Sequence: Synthetic polynucleotide
gcatcacctacctatattatttatcattccacatgcgttattattaaattttaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 127 - DNA, 1737 bp, Artificial Sequence
  Description of Artificial Sequence: Synthetic polynucleotide
gcatctaaacaacatattccccctaaaccaaaatatttagggtataaaaattaaaaaatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgttta

SEQ ID NO: 128 - DNA, 1200 bp, Artificial Sequence
  Description of Artificial Sequence: Synthetic polynucleotide
gcatcatctacctttattaatcaacaatccaaattattaataaaaaaaatttaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 129 - DNA, 1200 bp, Artificial Sequence
  Description of Artificial Sequence: Synthetic polynucleotide
gcatcaactacctaaattacttatcaaaccacttagtagtaaaaaaaatataacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 130 - DNA, 1200 bp, Artificial Sequence
  Description of Artificial Sequence: Synthetic polynucleotide
gcatcactattacaaaaaaaacaccaatattacatggtctcttttaaatattataaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 131 - DNA, 1200 bp, Artificial Sequence
  Description of Artificial Sequence: Synthetic polynucleotide
gcatcatctacctatattactaaacaaaccaattataataattttaaaaataaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 132 - DNA, 1200 bp, Artificial Sequence
  Description of Artificial Sequence: Synthetic polynucleotide
gcatcacctacctctattactaatcaaaccatttaaatgtagtaaaaatataataaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 133 - DNA, 1200 bp, Artificial Sequence
  Description of Artificial Sequence: Synthetic polynucleotide
gcatcaactacctaaattaataaacacaccaacttccatgaataaaaatataaaaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 134 - DNA, 1200 bp, Artificial Sequence
  Description of Artificial Sequence: Synthetic polynucleotide
gcatcatctacctatattatttaccaccccacctaactttagattaaaatttacaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 135 - DNA, 1200 bp, Artificial Sequence
  Description of Artificial Sequence: Synthetic polynucleotide
gcatcacctaccttcattactcaccataccaactagcacagttataaaaataagaaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatca

SEQ ID NO: 136 - DNA, 1305 bp, Artificial Sequence
  Description of Artificial Sequence: Synthetic polynucleotide
gcatcatctacctaaattaataaacaacccatttataaaccctttaaaattaacaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 137 - DNA, 1305 bp, Artificial Sequence
  Description of Artificial Sequence: Synthetic polynucleotide
gcatcttaatcaattttaaactcaccaaatcaaaatatgaaaaaaaaaaataataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 138 - DNA, 1304 bp, Artificial Sequence
  Description of Artificial Sequence: Synthetic polynucleotide
gcatcatctaccttaattaataaacaaaccaatttaactaatttaaaaaatataaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 139 - DNA, 1305 bp, Artificial Sequence
  Description of Artificial Sequence: Synthetic polynucleotide
gcatcatctaccttcattattaatcattccaattgtatcacttaaaaatataaaaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 140 - DNA, 1305 bp, Artificial Sequence
  Description of Artificial Sequence: Synthetic polynucleotide
gcatcttaatcaattttaaactcaccaaatcaaatatcacgtaaaaaatataagaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 141 - DNA, 1305 bp, Artificial Sequence
  Description of Artificial Sequence: Synthetic polynucleotide
gcatcaactacctcaattatttaacacaccaattactatacgtaaaaatataaaaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 142 - DNA, 1305 bp, Artificial Sequence
  Description of Artificial Sequence: Synthetic polynucleotide
gcatcttaatcaattttaaactcaccaaatcaaaaaaatgcgtataaaaattaaaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 143 - DNA, 1305 bp, Artificial Sequence
  Description of Artificial Sequence: Synthetic polynucleotide
gcatcttaatcaattttaaactcaccaaatcaaaggccgacttaaaaatattagaaaatgtcaactccacttcaaggaattaaagttctcgatttcaccggtgtgcaatctggcccatcttgtactcaaatgctggcctggtttggcgctgacgttattaaaattgaacgtcccggcgttggtgacgtaacgcgtcaccagctgcgagatattcctgatatcgatgcgctttacttcaccatgcttaacagtaacaaacgttctattgagttaaataccaaaacagcggaaggcaaagaggtaatggaaaagctgatccgcgaagctgatatcttagtcgagaactttcatccaggggccattgatcacatgggcttcacctgggagcatattcaagaaatcaatccacgtctgatttttggttcgatcaaagggtttgatgagtgttcgccttatgtgaatgtaaaagcctatgaaaacgttgctcaggcagcgggtggcgcggcatccactacgggtttttgggatggtccgccgctggtaagcgctgcagcgttgggtgacagcaacaccggaatgcatttgctgatcggtttacttgctgctttgctgcatcgcgaaaaaacggggcgtgggcaacgagtcaccatgtcaatgcaggatgccgtattgaacctttgccgcgtgaaattacgtgaccagcagcgtctagataaattgggttatctggaagaatacccgcagtatccgaatggtacatttggtgatgcagttccccgcggtggtaatgcaggtggtggcggtcagcctggctggatcctgaaatgtaaaggctgggaaaccgatcctaacgcctatatttatttcactattcaggagcaaaactgggaaaacacctgtaaagccatcggcaaaccagaatggattaccgatccggcatacagtacagcccatgcacgacagccacatattttcgatatttttgctgaaatcgaaaaatacactgtcactattgataaacatgaagcggtggcctatttgactcagtttgatattccttgtgcaccggttttaagtatgaaagaaatttcacttgatccctctttgcgccaaagtggcagtgttgttgaagtggaacaaccgttgcgtggaaaatatctgaccgttggttgtccaatgaaattctctgcctttacgccggatattaaagctgcgccgctattaggtgaacataccgctgctgtattgcaggagctgggttatagcgacgatgaaattgctgcaatgaagcaaaaccacgccatc

SEQ ID NO: 144 - DNA, 1311 bp, Artificial Sequence
  Description of Artificial Sequence: Synthetic polynucleotide
gcatcacctaaaaattataaataaattaataaaccttttaacataaaaattaataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 145 - DNA, 1311 bp, Artificial Sequence
  Description of Artificial Sequence: Synthetic polynucleotide
gcatcacctaaaaattataaataaattaataaacttttattaaaaaaaaattacaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 146 - DNA, 1311 bp, Artificial Sequence
  Description of Artificial Sequence: Synthetic polynucleotide
gcatcacctaaaaattataaataaattaataaacataacataaataaaattaataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 147 - DNA, 1311 bp, Artificial Sequence
  Description of Artificial Sequence: Synthetic polynucleotide
gcatcacctaaaaattataaataaattaataaaccacaatactaaaaatttaataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 148 - DNA, 1311 bp, Artificial Sequence
  Description of Artificial Sequence: Synthetic polynucleotide
gcatcaactacctacattaataaccaacccaaatgcctaatcaataaatattataaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 149 - DNA, 1311 bp, Artificial Sequence
  Description of Artificial Sequence: Synthetic polynucleotide
gcatcatctacctatattattcatcaaaccatttgatccaacattaaatattaaaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 150 - DNA, 1311 bp, Artificial Sequence
  Description of Artificial Sequence: Synthetic polynucleotide
gcatcacctacctcaattattaatcataccaactggatttgatttaaaaataagaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 151 - DNA, 1311 bp, Artificial Sequence
  Description of Artificial Sequence: Synthetic polynucleotide
gcatcacctacctttattactcatcataccaaatggtagcggattaaatattagaaaatgaataatccacaaacaggacaatcaacaggcctcttgggcaatcgttggttctacttggtattagcagttttgctgatgtgtatgatctcgggtgtccaatattcctggacactgtacgctaacccggttaaagacaaccttggcgtttctttggctgcggttcagacggctttcacactctctcaggtcattcaagctggttctcagcctggtggtggttacttcgttgataaattcggtccaagaattccattgatgttcggtggtgcgatggttctcgctggctggaccttcatgggtatggttgacagtgttcctgctctgtatgctctttatactctggccggtgcaggtgttggtatcgtttacggtatcgcgatgaacacggctaacagatggttcccggacaaacgcggtctggcttccggtttcaccgctgccggttacggtctgggtgttctgccgttcctgccactgatcagctccgttctgaaagttgaaggtgttggcgcagcattcatgtacaccggtttgatcatgggtatcctgattatcctgatcgctttcgttatccgtttccctggccagcaaggcgccaaaaaacaaatcgttgttaccgacaaggatttcaattctggcgaaatgctgagaacaccacaattctgggttctgtggaccgcattcttttccgttaactttggtggtttgctgctggttgccaacagcgtcccttacggtcgcagcctcggtcttgccgcaggtgtgctgacgatcggtgtttcgatccagaacctgttcaatggtggttgccgtcctttctggggtttcgtttccgataaaatcggccgttacaaaaccatgtccgtcgttttcggtatcaatgctgttgttctcgcacttttcccgacgattgctgccttgggcgatgtagcctttatcgccatgttggcaatcgcattcttcacatggggtggtagctacgctctgttcccatcgaccaacagcgatattttcggtacggcatactctgccagaaactatggtttcttctgggctgcaaaagcaactgcctcgatcttcggtggtggtctgggtgctgcaattgcaaccaacttcggatggaataccgctttcctgattactgcgattacttctttcatcgcatttgctctggctaccttcgttattccaagaatgggccgtccagtcaagaaaatggtcaaattgtctccagaagaaaaagctgtacat

SEQ ID NO: 152 - DNA, 1737 bp, Artificial Sequence
  Description of Artificial Sequence: Synthetic polynucleotide
gcatcatctaccttaattaatcaacaaaccaattaccaacctaaaaaatataagaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 153 - DNA, 1737 bp, Artificial Sequence
  Description of Artificial Sequence: Synthetic polynucleotide
gcatcaactacctttattattcaacaaaccaatttaacatattaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 154 - DNA, 1737 bp, Artificial Sequence
  Description of Artificial Sequence: Synthetic polynucleotide
gcatctacccctaacaacccataaatttaactttaaaaaatttttaaatataataaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 155 - DNA, 1737 bp, Artificial Sequence
  Description of Artificial Sequence: Synthetic polynucleotide
gcatcatctaccttcattattaaacaaaccaaattaatatcataaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 156 - DNA, 1737 bp, Artificial Sequence
  Description of Artificial Sequence: Synthetic polynucleotide
gcatctacccctaacaacccataaatttaacttttctacaaaaaaaaatataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 157 - DNA, 1737 bp, Artificial Sequence
  Description of Artificial Sequence: Synthetic polynucleotide
gcatcacctacctacattaataaccataccatctcagttttaaataaattttaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 158 - DNA, 1737 bp, Artificial Sequence
  Description of Artificial Sequence: Synthetic polynucleotide
gcatcacctaccttaattaatcaccattccatatcctttcaaaaaaaatataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 159 - DNA, 1736 bp, Artificial Sequence
  Description of Artificial Sequence: Synthetic polynucleotide
gcatcacctacctctattaatcatcattccaatttaggctcattaaatattagaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 160 - DNA, 1737 bp, Artificial Sequence; identical to SEQ ID NO: 152
  Description of Artificial Sequence: Synthetic polynucleotide

SEQ ID NO: 161 - DNA, 1737 bp, Artificial Sequence
  Description of Artificial Sequence: Synthetic polynucleotide
gcatcaactacctttattattcaacaaaccaatttaacatagtaaaaaaataaaaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 162 - DNA, 1737 bp, Artificial Sequence
  Description of Artificial Sequence: Synthetic polynucleotide
gcatctacccctaacaacccataaatttaactttaaaaaatttttaaatataagaaaatgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 163 - DNA, 1680 bp, Artificial Sequence
  Description of Artificial Sequence: Synthetic polynucleotide
atgactaccacagcaacgcagcattttgcccagttactccagaagtacggaattgatactgtcttcggcatagtaggtattccgatcgtgcagttggccgacactatggtcgcgaatggaattaagtttataccgtgtcgcaatgagcaagccgcaagttacgcggcaagcgcctacggctacatctcggacaaacctggtgtcctgttaatcgtgggagggcctggccttattcatgccttagcggggatctataatagtatgtcgaaccgctggcccttgttggtcatcgccggatccagcagccagtcagacatccacaagggaggtttccaggaacttgaccaggtgtccttgctaagtccgttcctaaaattcactggtaaactgacgccggataacatcgatatgataacccaaaaagcactcaactattgcattcagggaaccgccggagtgagctatatcgatgtccccgctgacttcatcgaatacgagaagccgcttgagggcaatgatagaactggtaacgagctgccaatgatcctgacgcccaatatctgcggtccagaccccagtaaaattaagaaggtggtgcaattgatactccagcacaagaacaagaacatattaatagtgataggtaaaggagcagtgaagaatagccatgagattagacgcttggttaacacctttaacttgccgttccttccgactcccatggcgaaaggcatagtgcccgatagcagccctttaaatgtgagcagcgcccggagccaggctcttaagattgctgacatcgtgttagtattgggagctcgcctgaattggatccttcacttcggaacgagtccaaagtggaatagcgagagtatttttatacaatttgacagtaacccggaaacgctcggagacaataacgttagtcccggagcagatttaagtatctggggggacatcggactatcggttactgcactggtagaagagctcacgagacaggacagttgttggaaatactcgggagtcaaacaggagatcagggaaaagatacagttaaaccagaccagattgctccgtaaggaaaaaacgcgtggagctcagcttaactataatcaagtgtacggcacccttcgtccgttaattgacgactatcgcacgatcttggtcacagaaggtgccaacacaatggacatcgctagaataagttttccgactgatgcacctcgcagaagacttgatgctggtacaaatgctacaatgggtataggtttaggttacgcattagcgtgtaaagccagccaccctgagttagacgttgttttaatccaaggcgacagtgccttcggttttagcgctatggagatcgagactgccgtccgttgccaattagcccttgtgattgtcgtaatgaataactctgggatatatcacggtgagaaagacatcgaaggagatctgcccccgaccgctttgtcaaaaaattgtagatatgacttggtcggtaagggtttaggagctaacgacttcttcgtcaataccatctcagagttatctcgctgttttcagcaggcagttcaattgagcagaaccaagcgcgaaacctccgtcattaatgtcataatcgaaccgggagagcagaaacagatcgcgttcgcatggcaaaacaagcctagactg

SEQ ID NO: 164 - DNA, 57 bp, Artificial Sequence
  Description of Artificial Sequence: Synthetic oligonucleotide
gcatctaaactaaaatacaataaccaaaaatcattacaaatgaaaaaaaataataaa

SEQ ID NO: 165 - DNA, 57 bp, Artificial Sequence
  Description of Artificial Sequence: Synthetic oligonucleotide
gcatctaaactaaaatacaataaccaaaaatcatgtttaacaaataaaaataataaa

SEQ ID NO: 166 - DNA, 57 bp, Artificial Sequence
  Description of Artificial Sequence: Synthetic oligonucleotide
gcatctaaactaaaatacaataaccaaaaatcatctatgcgtaaaaaaaattataaa

SEQ ID NO: 167 - DNA, 57 bp, Artificial Sequence
  Description of Artificial Sequence: Synthetic oligonucleotide
gcatctaaactaaaatacaataaccaaaaatcatactacatgtataaaattaaaaaa

SEQ ID NO: 168 - DNA, 57 bp, Artificial Sequence
  Description of Artificial Sequence: Synthetic oligonucleotide
gcatctaaactaaaatacaataaccaaaaatcattttcacaatataaaaataacaaa

SEQ ID NO: 169 - DNA, 57 bp, Artificial Sequence
  Description of Artificial Sequence: Synthetic oligonucleotide
gcatcatctacctcaattattcaccattccatctgtctagccaaaaaatttaaaaaa

SEQ ID NO: 170 - DNA, 57 bp, Artificial Sequence
  Description of Artificial Sequence: Synthetic oligonucleotide
gcatcatctacctaaattactcatcatcccattttagtcagcttaaaatattataaa

SEQ ID NO: 171 - DNA, 57 bp, Artificial Sequence
  Description of Artificial Sequence: Synthetic oligonucleotide
gcatcatctacctatattatttatcattccatatcatgcgtgaataaaaataataaa

SEQ ID NO: 172 - DNA, 57 bp, Artificial Sequence
  Description of Artificial Sequence: Synthetic oligonucleotide
gcatcatctacctatattaatcatcaacccaattttcatatgtataaaattaacaaa

SEQ ID NO: 173 - DNA, 57 bp, Artificial Sequence
  Description of Artificial Sequence: Synthetic oligonucleotide
gcatcttttccataacaaaaattaaacctcctccatatgaaaaataaaaattataaa

SEQ ID NO: 174 - DNA, 57 bp, Artificial Sequence
  Description of Artificial Sequence: Synthetic oligonucleotide
gcatcaactacctcaattaataatcaaaccatctgaacaatgaataaatttaaaaaa

SEQ ID NO: 175 - DNA, 57 bp, Artificial Sequence
  Description of Artificial Sequence: Synthetic oligonucleotide
gcatcttttccataacaaaaattaaacctcctccatatgagatataaaattaacaaa

SEQ ID NO: 176 - DNA, 57 bp, Artificial Sequence
  Description of Artificial Sequence: Synthetic oligonucleotide
gcatcaactaccttaattattcatcaaaccatataacatactaaaaaaaataacaaa

SEQ ID NO: 177 - DNA, 57 bp, Artificial Sequence
  Description of Artificial Sequence: Synthetic oligonucleotide
gcatcatctacctatattactaatcattccaattaattaccttataaaattaagaaa

SEQ ID NO: 178 - DNA, 57 bp, Artificial Sequence
  Description of Artificial Sequence: Synthetic oligonucleotide
gcatcttttccataacaaaaattaaacctcctcccccccacgtttaaaattaaaaaa

SEQ ID NO: 179 - DNA, 57 bp, Artificial Sequence
  Description of Artificial Sequence: Synthetic oligonucleotide
gcatcaactaccttcattacttaacaatccacctgttgtgagtaaaaatataagaaa

SEQ ID NO: 180 - DNA, 57 bp, Artificial Sequence
  Description of Artificial Sequence: Synthetic oligonucleotide
gcatccccaaaaaattaattcattttctcttttccctaacccttaaaatataataaa

SEQ ID NO: 181 - DNA, 57 bp, Artificial Sequence
  Description of Artificial Sequence: Synthetic oligonucleotide
gcatcaactacctaaattaattatcaccccaaattaataacataaaaatataataaa

SEQ ID NO: 182 - DNA, 57 bp, Artificial Sequence; identical to SEQ ID NO: 181
  Description of Artificial Sequence: Synthetic oligonucleotide

SEQ ID NO: 183 - DNA, 57 bp, Artificial Sequence
  Description of Artificial Sequence: Synthetic oligonucleotide
gcatccccaaaaaattaattcattttctcttttcaacaatttaaaaaaaattaaaaa

SEQ ID NO: 184 - DNA, 57 bp, Artificial Sequence
  Description of Artificial Sequence: Synthetic oligonucleotide
gcatccccaaaaaattaattcattttctcttttcgatcctataaaaaatataacaaa

SEQ ID NO: 185 - DNA, 57 bp, Artificial Sequence
  Description of Artificial Sequence: Synthetic oligonucleotide
gcatcatctacctttattattaatcaatccatctcagtaagtttaaaatataacaaa

SEQ ID NO: 186 - DNA, 57 bp, Artificial Sequence
  Description of Artificial Sequence: Synthetic oligonucleotide
gcatcaactacctctattaataatcaatccacatcttgatcgtaaaaaatttaaaaa

SEQ ID NO: 187 - DNA, 57 bp, Artificial Sequence
  Description of Artificial Sequence: Synthetic oligonucleotide
gcatcacctacctaaattactaaacaaaccacctgcatttgttttaaaaattacaaa

SEQ ID NO: 188 - DNA, 57 bp, Artificial Sequence
  Description of Artificial Sequence: Synthetic oligonucleotide
gcatcaactacctaaattaatcatcaaaccaactagaatatgaaaaaaaataaaaaa

SEQ ID NO: 189 - DNA, 57 bp, Artificial Sequence
  Description of Artificial Sequence: Synthetic oligonucleotide
gcatcaactacctcaattaataaacaaaccaactgtccaatgtataaaattaaaaaa

SEQ ID NO: 190 - DNA, 57 bp, Artificial Sequence
  Description of Artificial Sequence: Synthetic oligonucleotide
gcatcaactacctcaattactaaacaatccacattattaatataaaaatataaaaaa

SEQ ID NO: 191 - DNA, 56 bp, Artificial Sequence
  Description of Artificial Sequence: Synthetic oligonucleotide
gcatcaacacctaaattaattaacacaccatatattaaaccataaaaaataagaaa

SEQ ID NO: 192 - DNA, 57 bp, Artificial Sequence
  Description of Artificial Sequence: Synthetic oligonucleotide
gcatcttctacccatattccccctaatcccatctgttatattattaaatttaataaa

SEQ ID NO: 193 - DNA, 57 bp, Artificial Sequence
  Description of Artificial Sequence: Synthetic oligonucleotide
gcatcatctacctacattatttaacaaaccacatttaaaaggaaaaaatattaaaaa

SEQ ID NO: 194 - DNA, 57 bp, Artificial Sequence
  Description of Artificial Sequence: Synthetic oligonucleotide
gcatcacctacctatattatttatcattccacatgcgttattattaaattttaaaaa

SEQ ID NO: 195 - DNA, 57 bp, Artificial Sequence
  Description of Artificial Sequence: Synthetic oligonucleotide
gcatctaaacaacatattccccctaaaccaaaatatttagggtataaaaattaaaaa

SEQ ID NO: 196 - DNA, 57 bp, Artificial Sequence
  Description of Artificial Sequence: Synthetic oligonucleotide
gcatcatctacctttattaatcaacaatccaaattattaataaaaaaaatttaaaaa

SEQ ID NO: 197 - DNA, 57 bp, Artificial Sequence
  Description of Artificial Sequence: Synthetic oligonucleotide
gcatcaactacctaaattacttatcaaaccacttagtagtaaaaaaaatataacaaa

SEQ ID NO: 198 - DNA, 57 bp, Artificial Sequence
  Description of Artificial Sequence: Synthetic oligonucleotide
gcatcactattacaaaaaaaacaccaatattacatggtctcttttaaatattataaa

SEQ ID NO: 199 - DNA, 57 bp, Artificial Sequence
  Description of Artificial Sequence: Synthetic oligonucleotide
gcatcatctacctatattactaaacaaaccaattataataattttaaaaataaaaaa

SEQ ID NO: 200 - DNA, 57 bp, Artificial Sequence
  Description of Artificial Sequence: Synthetic oligonucleotide
gcatcacctacctctattactaatcaaaccatttaaatgtagtaaaaatataataaa

SEQ ID NO: 201 - DNA, 57 bp, Artificial Sequence
  Description of Artificial Sequence: Synthetic oligonucleotide
gcatcaactacctaaattaataaacacaccaacttccatgaataaaaatataaaaaa

SEQ ID NO: 202 - DNA, 57 bp, Artificial Sequence
  Description of Artificial Sequence: Synthetic oligonucleotide
gcatcatctacctatattatttaccaccccacctaactttagattaaaatttacaaa

SEQ ID NO: 203 - DNA, 57 bp, Artificial Sequence
  Description of Artificial Sequence: Synthetic oligonucleotide
gcatcacctaccttcattactcaccataccaactagcacagttataaaaataagaaa

SEQ ID NO: 204 - DNA, 57 bp, Artificial Sequence
  Description of Artificial Sequence: Synthetic oligonucleotide
gcatcatctacctaaattaataaacaacccatttataaaccctttaaaattaacaaa

SEQ ID NO: 205 - DNA, 57 bp, Artificial Sequence
  Description of Artificial Sequence: Synthetic oligonucleotide
gcatcttaatcaattttaaactcaccaaatcaaaatatgaaaaaaaaaaataataaa

SEQ ID NO: 206 - DNA, 56 bp, Artificial Sequence
  Description of Artificial Sequence: Synthetic oligonucleotide
gcatcatctaccttaattaataaacaaaccaatttaactaatttaaaaaatataaa

SEQ ID NO: 207 - DNA, 57 bp, Artificial Sequence
  Description of Artificial Sequence: Synthetic oligonucleotide
gcatcatctaccttcattattaatcattccaattgtatcacttaaaaatataaaaaa

SEQ ID NO: 208 - DNA, 57 bp, Artificial Sequence
  Description of Artificial Sequence: Synthetic oligonucleotide
gcatcttaatcaattttaaactcaccaaatcaaatatcacgtaaaaaatataagaaa

SEQ ID NO: 209 - DNA, 57 bp, Artificial Sequence
  Description of Artificial Sequence: Synthetic oligonucleotide
gcatcaactacctcaattatttaacacaccaattactatacgtaaaaatataaaaaa

SEQ ID NO: 210 - DNA, 57 bp, Artificial Sequence
  Description of Artificial Sequence: Synthetic oligonucleotide
gcatcttaatcaattttaaactcaccaaatcaaaaaaatgcgtataaaaattaaaaa

SEQ ID NO: 211 - DNA, 57 bp, Artificial Sequence
  Description of Artificial Sequence: Synthetic oligonucleotide
gcatcttaatcaattttaaactcaccaaatcaaaggccgacttaaaaatattagaaa

SEQ ID NO: 212 - DNA, 57 bp, Artificial Sequence
  Description of Artificial Sequence: Synthetic oligonucleotide
gcatcacctaaaaattataaataaattaataaaccttttaacataaaaattaataaa

SEQ ID NO: 213 - DNA, 57 bp, Artificial Sequence
  Description of Artificial Sequence: Synthetic oligonucleotide
gcatcacctaaaaattataaataaattaataaacttttattaaaaaaaaattacaaa

SEQ ID NO: 214 - DNA, 57 bp, Artificial Sequence
  Description of Artificial Sequence: Synthetic oligonucleotide
gcatcacctaaaaattataaataaattaataaacataacataaataaaattaataaa

SEQ ID NO: 215 - DNA, 57 bp, Artificial Sequence
  Description of Artificial Sequence: Synthetic oligonucleotide
gcatcacctaaaaattataaataaattaataaaccacaatactaaaaatttaataaa

SEQ ID NO: 216 - DNA, 57 bp, Artificial Sequence
  Description of Artificial Sequence: Synthetic oligonucleotide
gcatcaactacctacattaataaccaacccaaatgcctaatcaataaatattataaa

SEQ ID NO: 217 - DNA, 57 bp, Artificial Sequence
  Description of Artificial Sequence: Synthetic oligonucleotide
gcatcatctacctatattattcatcaaaccatttgatccaacattaaatattaaaaa

SEQ ID NO: 218 - DNA, 57 bp, Artificial Sequence
  Description of Artificial Sequence: Synthetic oligonucleotide
gcatcacctacctcaattattaatcataccaactggatttgatttaaaaataagaaa

SEQ ID NO: 219 - DNA, 57 bp, Artificial Sequence
  Description of Artificial Sequence: Synthetic oligonucleotide
gcatcacctacctttattactcatcataccaaatggtagcggattaaatattagaaa

SEQ ID NO: 220 - DNA, 57 bp, Artificial Sequence
  Description of Artificial Sequence: Synthetic oligonucleotide
gcatcatctaccttaattaatcaacaaaccaattaccaacctaaaaaatataagaaa

SEQ ID NO: 221 - DNA, 57 bp, Artificial Sequence
  Description of Artificial Sequence: Synthetic oligonucleotide
gcatcaactacctttattattcaacaaaccaatttaacatattaaaaaaataaaaaa

SEQ ID NO: 222 - DNA, 57 bp, Artificial Sequence
  Description of Artificial Sequence: Synthetic oligonucleotide
gcatctacccctaacaacccataaatttaactttaaaaaatttttaaatataataaa

SEQ ID NO: 223 - DNA, 57 bp, Artificial Sequence
  Description of Artificial Sequence: Synthetic oligonucleotide
gcatcatctaccttcattattaaacaaaccaaattaatatcataaaaaaataaaaaa

SEQ ID NO: 224 - DNA, 57 bp, Artificial Sequence
  Description of Artificial Sequence: Synthetic oligonucleotide
gcatctacccctaacaacccataaatttaacttttctacaaaaaaaaatataaaaaa

SEQ ID NO: 225 - DNA, 57 bp, Artificial Sequence
  Description of Artificial Sequence: Synthetic oligonucleotide
gcatcacctacctacattaataaccataccatctcagttttaaataaattttaaaaa

SEQ ID NO: 226 - DNA, 57 bp, Artificial Sequence
  Description of Artificial Sequence: Synthetic oligonucleotide
gcatcacctaccttaattaatcaccattccatatcctttcaaaaaaaatataaaaaa

SEQ ID NO: 227 - DNA, 56 bp, Artificial Sequence
  Description of Artificial Sequence: Synthetic oligonucleotide
gcatcacctacctctattaatcatcattccaatttaggctcattaaatattagaaa

SEQ ID NO: 228 - DNA, 57 bp, Artificial Sequence; identical to SEQ ID NO: 220
  Description of Artificial Sequence: Synthetic oligonucleotide

SEQ ID NO: 229 - DNA, 57 bp, Artificial Sequence
  Description of Artificial Sequence: Synthetic oligonucleotide
gcatcaactacctttattattcaacaaaccaatttaacatagtaaaaaaataaaaaa

SEQ ID NO: 230 - DNA, 57 bp, Artificial Sequence
  Description of Artificial Sequence: Synthetic oligonucleotide
gcatctacccctaacaacccataaatttaactttaaaaaatttttaaatataagaaa

SEQ ID NO: 231 - DNA, 23 bp, Artificial Sequence
  Description of Artificial Sequence: Synthetic oligonucleotide
  modified_base (1)..(8): a, c, t, g, unknown or other
  modified_base (20)..(20): a, c, t, g, unknown or other
nnnnnnnnwwwaaawwtwanaaa

What is claimed is:

1. A commensal bacterium comprising one or more transgenes encoding a protein that increases the oxalate degrading activity of the bacterium relative to an unmodified bacterium and increases the ability of the bacterium to utilize a privileged nutrient as a carbon source, wherein the bacterium comprises:
   (a) one or more transgenes encoding a *S. cerevisiae* OXS, a *S. cerevisiae* OXC, and an *O. formigenes* OxIT;
   (b) one or more transgenes encoding an *E. coli* FCOCT, an *O. formigenes* OXC, a *S. cerevisiae* OXS, and an *O. formigenes* OxIT;
   (c) one or more transgenes encoding an *E. coli* FCOCT, an *O. formigenes* OXC, a *S. cerevisiae* OXS, a *S. cerevisiae* OXC, an *E. coli* ACOCT, and an *O. formigenes* OxIT;
   (d) one or more transgenes encoding an *E. coli* FCOCT, an *O. formigenes* OXC, a *S. cerevisiae* OXS, a *S. cerevisiae* OXC, an *A. thaliana* OXS, an *E. coli* ACOCT, and an *O. formigenes* OxIT;
   (e) one or more transgenes encoding an *E. coli* FCOCT, an *O. formigenes* OXC, an *O. formigenes* OxIT, an *E. coli* ACOCT, and a *S. cerevisiae* OXS;
   (f) one or more transgenes encoding an *O. formigenes* OxIT, an *E. coli* FCOCT, a *S. cerevisiae* OXC, an *E. coli* ACOCT, a *S. cerevisiae* OXS, and an *A. thaliana* OXS; or
   (g) one or more transgenes encoding an *O. formigenes* OxIT, an *E. coli* FCOCT, a *S. cerevisiae* OXC, an *E. coli* ACOCT, and a *S. cerevisiae* OXS.

2. The bacterium of claim 1, wherein the bacterium comprises one or more nucleic acids comprising a nucleotide sequence having at least 95% identity to any one of SEQ ID NOs: 1-31.

3. The bacterium of claim 2, wherein the bacterium comprises:
   (a) one or more nucleic acids comprising a nucleotide sequence having at least 95% identity to SEQ ID NO: 16, a nucleotide sequence having at least 95% identity to SEQ ID NO: 26 or SEQ ID NO: 163, and a nucleotide sequence having at least 95% identity to SEQ ID NO: 21;
   (b) one or more nucleic acids comprising a nucleotide sequence having at least 95% identity to SEQ ID NO: 7, a nucleotide sequence having at least 95% identity to SEQ ID NO: 25, a nucleotide sequence having at least 95% identity to SEQ ID NO: 16, and a nucleotide sequence having at least 95% identity to SEQ ID NO: 21;
   (c) one or more nucleic acids comprising a nucleotide sequence having at least 95% identity to SEQ ID NO: 7, a nucleotide sequence having at least 95% identity to SEQ ID NO: 25, a nucleotide sequence having at least 95% identity to SEQ ID NO: 16, a nucleotide sequence having at least 95% identity to SEQ ID NO: 26 or SEQ ID NO: 163, a nucleotide sequence having at least 95% identity to SEQ ID NO: 2, and a nucleotide sequence having at least 95% identity to SEQ ID NO: 21;
   (d) one or more nucleic acids comprising a nucleotide sequence having at least 95% identity to SEQ ID NO: 7, a nucleotide sequence having at least 95% identity to SEQ ID NO: 25, a nucleotide sequence having at least 95% identity to SEQ ID NO: 16, a nucleotide sequence having at least 95% identity to SEQ ID NO: 26 or SEQ ID NO: 163, a nucleotide sequence having at least 95% identity to SEQ ID NO: 14, a nucleotide sequence having at least 95% identity to SEQ ID NO: 2, and a nucleotide sequence having at least 95% identity to SEQ ID NO: 21;
   (e) one or more nucleic acids comprising a nucleotide sequence having at least 95% identity to SEQ ID NO: 7, a nucleotide sequence having at least 95% identity to SEQ ID NO: 25, a nucleotide sequence having at least 95% identity to SEQ ID NO: 21, a nucleotide sequence having at least 95% identity to SEQ ID NO: 2, and a nucleotide sequence having at least 95% identity to SEQ ID NO: 16;
   (f) one or more nucleic acids comprising a nucleotide sequence having at least 95% identity to SEQ ID NO: 21, a nucleotide sequence having at least 95% identity to SEQ ID NO: 7, a nucleotide sequence having at least 95% identity to SEQ ID NO: 26 or SEQ ID NO: 163, a nucleotide sequence having at least 95% identity to SEQ ID NO: 2, a nucleotide sequence having at least 95% identity to SEQ ID NO: 16, and a nucleotide sequence having at least 95% identity to SEQ ID NO: 14; or (g) one or more nucleic acids comprising a nucleotide sequence having at least 95% identity to SEQ ID NO: 21, a nucleotide sequence having at least 95% identity to SEQ ID NO: 7, a nucleotide sequence having at least 95% identity to SEQ ID NO: 26 or SEQ ID NO: 163, a nucleotide sequence having at least 95% identity to SEQ ID NO: 2, and a nucleotide sequence having at least 95% identity to SEQ ID NO: 16.

4. The bacterium of claim 1, wherein at least one of the one or more transgenes is operably linked to a ribosome binding site (RBS), wherein the RBS comprises the nucleotide sequence any one of SEQ ID NOs: 164-230.

5. The bacterium of claim 1, wherein:
(i) the bacterium comprises a transgene encoding an *O. formigenes* OxIT operably linked to an RBS comprising the nucleotide sequence of any one of SEQ ID NOs: 212-219;
(ii) the bacterium comprises a transgene encoding a *S. cerevisiae* OXS operably linked to an RBS comprising the nucleotide sequence of any one of SEQ ID NOs: 172-179;
(iii) the bacterium comprises a transgene encoding an *A. thaliana* OXS operably linked to an RBS comprising the nucleotide sequence of any one of SEQ ID NOs: 164-171;
(iv) the bacterium comprises a transgene encoding a *S. cerevisiae* OXC operably linked to an RBS comprising the nucleotide sequence of any one of SEQ ID NOs: 188-195 or 220-230;
(v) the bacterium comprises a transgene encoding an *O. formigenes* OXC operably linked to an RBS comprising the nucleotide sequence of any one of SEQ ID NOs: 180-187;
(vi) the bacterium comprises a transgene encoding an *E. coli* FCOCT operably linked to an RBS comprising the nucleotide sequence of any one of SEQ ID NOs: 204-211; and/or
(vii) the bacterium comprises a transgene encoding an *E. coli* ACOCT operably linked to an RBS comprising the nucleotide sequence of any one of SEQ ID NOs: 196-203.

6. The bacterium of claim 1, wherein the bacterium comprises one or more nucleic acids comprising a nucleotide sequence having at least 95% identity to any one of SEQ ID NOs 96-162.

7. The bacterium of claim 6, wherein the bacterium comprises:
(i) one or more nucleic acids comprising a nucleotide sequence having at least 95% identity to SEQ ID NO: 137, a nucleotide sequence having at least 95% identity to SEQ ID NO: 113, a nucleotide sequence having at least 95% identity to SEQ ID NO: 145, a nucleotide sequence having at least 95% identity to SEQ ID NO: 128, and a nucleotide sequence having at least 95% identity to SEQ ID NO: 104;
(ii) one or more nucleic acids comprising a nucleotide sequence having at least 95% identity to SEQ ID NO: 155, a nucleotide sequence having at least 95% identity to SEQ ID NO: 137, a nucleotide sequence having at least 95% identity to SEQ ID NO: 128, a nucleotide sequence having at least 95% identity to SEQ ID NO: 148, a nucleotide sequence having at least 95% identity to SEQ ID NO: 115, a nucleotide sequence having at least 95% identity to SEQ ID NO: 98, and a nucleotide sequence having at least 95% identity to SEQ ID NO: 105;
(iii) one or more nucleic acids comprising a nucleotide sequence having at least 95% identity to SEQ ID NO: 155, a nucleotide sequence having at least 95% identity to SEQ ID NO: 137, a nucleotide sequence having at least 95% identity to SEQ ID NO: 128, a nucleotide sequence having at least 95% identity to SEQ ID NO: 144, a nucleotide sequence having at least 95% identity to SEQ ID NO: 115, a nucleotide sequence having at least 95% identity to SEQ ID NO: 98, and a nucleotide sequence having at least 95% identity to SEQ ID NO: 105;
(iv) one or more nucleic acids comprising a nucleotide sequence having at least 95% identity to SEQ ID NO: 147, a nucleotide sequence having at least 95% identity to SEQ ID NO: 104, a nucleotide sequence having at least 95% identity to SEQ ID NO: 153, a nucleotide sequence having at least 95% identity to SEQ ID NO: 97, a nucleotide sequence having at least 95% identity to SEQ ID NO: 131, a nucleotide sequence having at least 95% identity to SEQ ID NO: 136, and a nucleotide sequence having at least 95% identity to SEQ ID NO: 113;
(v) one or more nucleic acids comprising a nucleotide sequence having at least 95% identity to SEQ ID NO: 145, a nucleotide sequence having at least 95% identity to SEQ ID NO: 137, a nucleotide sequence having at least 95% identity to SEQ ID NO: 153, a nucleotide sequence having at least 95% identity to SEQ ID NO: 129, a nucleotide sequence having at least 95% identity to SEQ ID NO: 105, a nucleotide sequence having at least 95% identity to SEQ ID NO: 113, and a nucleotide sequence having at least 95% identity to SEQ ID NO: 96;
(vi) one or more nucleic acids comprising a nucleotide sequence having at least 95% identity to SEQ ID NO: 145, a nucleotide sequence having at least 95% identity to SEQ ID NO: 137, a nucleotide sequence having at least 95% identity to SEQ ID NO: 153, a nucleotide sequence having at least 95% identity to SEQ ID NO: 129, a nucleotide sequence having at least 95% identity to SEQ ID NO: 105, and a nucleotide sequence having at least 95% identity to SEQ ID NO: 96;
(vii) one or more nucleic acids comprising a nucleotide sequence having at least 95% identity to SEQ ID NO: 139, a nucleotide sequence having at least 95% identity to SEQ ID NO: 129, a nucleotide sequence having at least 95% identity to SEQ ID NO: 155, a nucleotide sequence having at least 95% identity to SEQ ID NO: 112, a nucleotide sequence having at least 95% identity to SEQ ID NO: 99, a nucleotide sequence having at least 95% identity to SEQ ID NO: 106, and a nucleotide sequence having at least 95% identity to SEQ ID NO: 145;
(viii) one or more nucleic acids comprising a nucleotide sequence having at least 95% identity to SEQ ID NO: 139, a nucleotide sequence having at least 95% identity to SEQ ID NO: 154, a nucleotide sequence having at least 95% identity to SEQ ID NO: 131, a nucleotide sequence having at least 95% identity to SEQ ID NO: 98, a nucleotide sequence having at least 95% identity to SEQ ID NO: 115, a nucleotide sequence having at least 95% identity to SEQ ID NO: 106, and a nucleotide sequence having at least 95% identity to SEQ ID NO: 149;
(ix) one or more nucleic acids comprising a nucleotide sequence having at least 95% identity to SEQ ID NO: 137, a nucleotide sequence having at least 95% identity to SEQ ID NO: 113, a nucleotide sequence having at least 95% identity to SEQ ID NO: 148, a nucleotide sequence having at least 95% identity to SEQ ID NO: 129, and a nucleotide sequence having at least 95% identity to SEQ ID NO: 105;

(x) one or more nucleic acids comprising a nucleotide sequence having at least 95% identity to SEQ ID NO: 145, a nucleotide sequence having at least 95% identity to SEQ ID NO: 137, a nucleotide sequence having at least 95% identity to SEQ ID NO: 153, a nucleotide sequence having at least 95% identity to SEQ ID NO: 129, and a nucleotide sequence having at least 95% identity to SEQ ID NO: 105;

(xi) one or more nucleic acids comprising a nucleotide sequence having at least 95% identity to SEQ ID NO: 155, a nucleotide sequence having at least 95% identity to SEQ ID NO: 137, a nucleotide sequence having at least 95% identity to SEQ ID NO: 128, a nucleotide sequence having at least 95% identity to SEQ ID NO: 144, a nucleotide sequence having at least 95% identity to SEQ ID NO: 115, a nucleotide sequence having at least 95% identity to SEQ ID NO: 98, and a nucleotide sequence having at least 95% identity to SEQ ID NO: 105;

(xii) one or more nucleic acids comprising a nucleotide sequence having at least 95% identity to SEQ ID NO: 145, a nucleotide sequence having at least 95% identity to SEQ ID NO: 137, a nucleotide sequence having at least 95% identity to SEQ ID NO: 153, a nucleotide sequence having at least 95% identity to SEQ ID NO: 129, a nucleotide sequence having at least 95% identity to SEQ ID NO: 105, a nucleotide sequence having at least 95% identity to SEQ ID NO: 113, and a nucleotide sequence having at least 95% identity to SEQ ID NO: 96;

(xiii) one or more nucleic acids comprising a nucleotide sequence having at least 95% identity to SEQ ID NO: 145, a nucleotide sequence having at least 95% identity to SEQ ID NO: 137, a nucleotide sequence having at least 95% identity to SEQ ID NO: 153, a nucleotide sequence having at least 95% identity to SEQ ID NO: 129, a nucleotide sequence having at least 95% identity to SEQ ID NO: 105, and a nucleotide sequence having at least 95% identity to SEQ ID NO: 96; or (xiv) one or more nucleic acids comprising a nucleotide sequence having at least 95% identity to SEQ ID NO: 139, a nucleotide sequence having at least 95% identity to SEQ ID NO: 129, a nucleotide sequence having at least 95% identity to SEQ ID NO: 155, a nucleotide sequence having at least 95% identity to SEQ ID NO: 112, a nucleotide sequence having at least 95% identity to SEQ ID NO: 99, a nucleotide sequence having at least 95% identity to SEQ ID NO: 106, and a nucleotide sequence having at least 95% identity to SEQ ID NO: 145.

8. A pharmaceutical composition comprising the bacterium of claim 1 and a pharmaceutically acceptable excipient.

9. The bacterium of claim 1, wherein the bacterium is of the genus *Bacteroides*.

10. The bacterium of claim 1, wherein at least one of the one or more transgenes is operably linked to at least one constitutive promoter.

11. The bacterium of claim 8, wherein the privileged nutrient is porphyran.

12. The pharmaceutical composition of claim 8, further comprising a privileged nutrient.

13. The pharmaceutical composition of claim 12, wherein the privileged nutrient is porphyran.

* * * * *